(12) United States Patent
Häsler et al.

(10) Patent No.: US 10,479,990 B2
(45) Date of Patent: Nov. 19, 2019

(54) SEMI-SYNTHETIC NURSE SHARK VNAR LIBRARIES FOR MAKING AND USING SELECTIVE BINDING COMPOUNDS

(71) Applicant: Ossianix, Inc., Philadelphia, PA (US)

(72) Inventors: Julien Häsler, Hitchin (GB); Julia Lynn Rutkowski, Bryn Mawr, PA (US)

(73) Assignee: Ossianix, Inc., Philadelphia, PA (US)

( * ) Notice: Subject to any disclaimer, the term of this patent is extended or adjusted under 35 U.S.C. 154(b) by 182 days.

(21) Appl. No.: 15/321,314

(22) PCT Filed: Jun. 26, 2015

(86) PCT No.: PCT/US2015/038166
§ 371 (c)(1),
(2) Date: Dec. 22, 2016

(87) PCT Pub. No.: WO2015/200883
PCT Pub. Date: Dec. 30, 2015

(65) Prior Publication Data
US 2017/0198281 A1    Jul. 13, 2017

Related U.S. Application Data

(60) Provisional application No. 62/017,456, filed on Jun. 26, 2014.

(51) Int. Cl.
*C40B 40/08*    (2006.01)
*C12N 15/10*    (2006.01)
(Continued)

(52) U.S. Cl.
CPC .......... *C12N 15/1055* (2013.01); *C07K 16/00* (2013.01); *C07K 16/005* (2013.01);
(Continued)

(58) Field of Classification Search
None
See application file for complete search history.

(56) References Cited

U.S. PATENT DOCUMENTS

2016/0333103 A1    11/2016    Häsler
2017/0348416 A1    12/2017    Häsler

FOREIGN PATENT DOCUMENTS

WO    WO2003/014161 A2    2/2003
WO    WO2005/118629 A1    12/2005
(Continued)

OTHER PUBLICATIONS

Barelle et al. (2009) "Shark novel antigen receptors—the next generation of biologic therapeutics?", Adv. Exp. Med. Biol., vol. 655, pp. 49-62.
(Continued)

*Primary Examiner* — Christian C Boesen
(74) *Attorney, Agent, or Firm* — Wilson IP Law

(57) ABSTRACT

The present invention relates to VNAR single chain antibodies and more particularly, to semi-synthetic VNAR libraries derived from nurse shark which may be used to identify individual clones, nucleic acid molecules and polypeptides which encode binding moieties that specifically bind to a cellular target of interest, thereby altering (e.g., antagonizing) target activity in a cell or mimicking the activity of a native molecule. The present invention thus also relates to compounds and compositions comprising a target specific VNAR binding moiety, methods for preparing them, and diagnostic and therapeutic methods of use relating to regulation, e.g., agonism or antagonism of the selected cellular target or target pathway e.g., to treat and/or prevent a pathological condition, disorder or disease in which it is
(Continued)

beneficial to alter, e.g., agonize or augment, antagonize, reduce or eliminate the specific cellular target activity.

11 Claims, 38 Drawing Sheets

Specification includes a Sequence Listing.

(51) Int. Cl.
    *C07K 16/00*     (2006.01)
    *C07K 16/22*     (2006.01)
    *C07K 16/28*     (2006.01)

(52) U.S. Cl.
    CPC .......... *C07K 16/22* (2013.01); *C07K 16/2875* (2013.01); *C07K 16/2881* (2013.01); *C12N 15/1037* (2013.01); *C07K 2317/20* (2013.01); *C07K 2317/565* (2013.01); *C07K 2317/567* (2013.01); *C07K 2317/569* (2013.01); *C07K 2317/72* (2013.01); *C07K 2317/76* (2013.01); *C07K 2317/92* (2013.01); *C07K 2319/30* (2013.01); *C40B 40/08* (2013.01)

(56) References Cited

FOREIGN PATENT DOCUMENTS

| WO | WO2009/026638 A1 | 3/2009 |
| WO | WO2014/173959 A2 | 10/2014 |
| WO | WO2015/100246 A1 | 7/2015 |

OTHER PUBLICATIONS

Diaz et al. (2002) "Structural analysis, selection, and ontogeny of the shark new antigen receptor (IgNAR): Identification of a new locus preferentially expressed in early development," Immunogenetics, vol. 54, pp. 501-512.

Fennell et al. (2010) "Dissection of the IgNAR V Domain: Molecular Scanning and Orthologue Database Mining Define Novel IgNAR Hallmarks and Affinity Maturation Mechanisms", J. Mol. Biol., vol. 400, pp. 155-170.

Greenberg et al. (1995) "A new antigen receptor gene family that undergoes rearrangement and extensive somatic diversification in sharks", Nature, vol. 374, pp. 168-173.

Kovalenko et al. (2013) "Atypical antigen recognition mode of a shark immunoglobulin new antigen receptor (IgNAR) variable domain characterized by humanization and structural analysis", J. Biol. Chem., vol. 288, pp. 17408-17419.

Kovaleva et al. (2014) "Shark variable new antigen receptor biologics—a novel technology platform for therapeutic drug development", Expert Opin. Biol. Therapy, vol. 14, pp. 1527-1539.

Müller et al. (2012) "Generation and isolation of target-specific single-domain antibodies from shark immune repertoires", Methods Mol. Biol., vol. 907, pp. 177-194.

Nuttall et al. (2003) "Isolation and characterization of an IgNAR variable domain specific for the human mitochondrial translocase receptor Tom70", Eur. J. Biochem., vol. 270, pp. 3543-3554.

Shao et al. (2007) "Rapid isolation of IgNAR variable single-domain antibody fragments from a shark synthetic library", Mol. Immunol., vol. 44, pp. 656-665.

Zielonka et al. (2014) "Shark Attack: High affinity binding proteins derived from shark vNAR domains by stepwise in vitro affinity maturation", J. Biotechnol., vol. 191, pp. 236-245.

Zielonka et al. (2014) "Structural insights and biomedical potential of IgNAR scaffolds from sharks", mAbs, vol. 7, pp. 15-25.

| | Clone ID | FW1 | * | CDR1 | FW2 | HV2 | FW2/ HV4 | FW3 | * | CDR3 | FW4 |
|---|---|---|---|---|---|---|---|---|---|---|---|
| 127 | 619043>F08 | ARVDQTPQTIKETGESLTIKETGESLTINCVLR- | | DSNCALS- | STYWYRKKSGS- | TNEESISKG- | GRYVETVN-SGSKS- | FSLRINDLTVEDSGTYRCNV-Y | | DQC~~VDV~ | YGGGTAVTVNA |
| 128 | 619043>E04 | ARVDQTPQTIKETGESLTINCVLR- | | DSNCALS- | STSWYRKQSGS- | TNEETISKG- | GRYVETVN-SGSKS- | FSLRINDLTVEDSGTYRCTG-RG | | RDLCT | NGGGTAVTVNA |
| 129 | 637859>C01 | ARVDQTPQTIKETGESLTINCVLR- | | DSNCALS- | STYWYRKKSGS- | TNEESISKS- | GRYVETVN-SGSKS- | FSLRITDLTVEDSGTYRCNV- | | YDSCW~~SWV~ | YGGGTAVTVNA |
| 130 | 619043>F10 | ARVDQTPQTIKETGESLTINCVLR- | | DSNCALS- | STYWYRKKSGS- | TNEESISKG- | GRYVETVN-SGSKS- | FSLRINDLTVEDSGTYRCNA-YG | | GL~~ | YGGGTVVTVNA |
| 131 | 619043>D04 | ARVDQTPQTIKETGESLTINCVLR- | | DSVCALS- | STYWYRKKSGS- | TNEESISKG- | GRYVETVN-SGSKS- | FSLRINDLTVEDSGTYRCNV-EGY | | IV~~ | QGGGTAVTVNA |
| 132 | 623991>A03 | ARVDQTPQTIKETGESLTINCVLR- | | DTNCALS- | RTYWNHKKSGS- | TNWEIISKG- | GRYVETVN-SGSKS- | FSLRINDLTVEDSGTYRCKP- | | LVCKQGWA | YGGGTVVTVNA |
| 133 | 623982>D11 | ARVDQTPQTIKETGESLTINCVLL- | | ESTCAVV- | GTYWYRKKSGS- | TNEESISKG- | GRY-ETFK-SGSKS- | FSLRINDLTVEDSGTYRCKS- | | LRCSAGYPD~~ | YGGGTAVTVNA |
| 134 | 637859>H06 | ARVDQTPQTIKETGESLTINCVLR- | | DSNCALS- | STYWYRKKSGS- | TNEESISKG- | GRYVETVN-SGSKS- | FQLRINDLTVEDSGTYRCNV-FCW | | TAPS | DV~YGGGTVVTVNA |
| 135 | 641310>B10 | ARVDQTPQTIKETGESLTINCALL- | | GSNCVFS- | STYWYRKKSGS- | TNEETISLG- | GRYSETVN-RGRKS- | FSLRINDLTVEDSGNYRCLG- | | CR~~ | EG~YER~YGGGTVVTVNA |
| 136 | 642375>A11 | ARVDQTPQTIKETGESLTINCVLS- | | ASTCILT- | ETILWLRNQSGS- | TNEEIISLG- | GRYSETVN-SGSKS- | FSLRINDLTVEDSGTYRCKV-AT | | KRCSAKFET~~ | YGGGTVVTVNA |
| 137 | 623977>D10 | ARVDQTPQTIKETGESLTINCVLR- | | DANCALA- | STYWYRKKSGS- | TNEESISKG- | GRYVETVN-SGSKS- | FSLRINDLTVEDSGTYRCNV- | | PNCRG~~YDV~ | YGGGTAVTVNA |
| 138 | 606164>B11 | ARVDQKPQTIKETGESLTINCVLR- | | DSNCALS- | STYWYRKKSGS- | TNEESISKG- | GRYVETVN-SGSKS- | FSLRINDLTVEDSGTYRCNV-WAG | | CYPPDDV~ | YGGGTAVTVNA |
| 139 | 608742>E04 | ARVDQTPQTIKETGESLTINCVLR- | | DSNCELS- | STYWYRKKSGS- | TNEESISKG- | GRYVETVN-SRSKS- | FSLRINDLRVEDSGTYRCNT-HS | | PWD~~CG~NWR~DVY~ | GGGGTVVTVNA |
| 140 | 637859>D07 | ARVDQTPQTIKETGESLTINCVLR- | | DSNCALS- | STYWYRKKSGS- | TNEESISKG- | GRYVETVN-SGSKS- | FSLRINDLTVEDSGTYRCNI-HS | | CRLWT | ADV~YGGGTVVTVNA |
| 141 | 641310>H05 | ARVDQTPQTIKETGESLTINCVLR- | | DSNCALS- | STYWYRQKSGS- | TNEESISKG- | GRYVETVN-SGSKS- | FSLRINDLTVEDSGTYRCKT-R | | CYSSRF~~ | VDV~YGGGTVVTVNA |
| 142 | 642375>G06 | ARVDQTPQTIKETGESLTINCVLR- | | DRPCCLS- | STYWYRQKSGS- | TNEESISKG- | GRYVETVN-SGSKS- | FSLRINDLTVEDSGTYRCVV-Y | | RVCRTV~~ | PV~YGGGTVVTVNA |
| 143 | 623982>A03 | ARVDQTPQTIKETGESLTINCVLR- | | DSICALS- | STDWLRKKSDY- | TNEENISKG- | GRYVETVN-SGSKS- | SSLRINDLTVEDSGTYRCKV-YCP | | DRQNWG~~ | RDV~YGGGTVVTVNA |
| 144 | 606164>A06 | ARVDQTPQTIKETGESLTINCVLR- | | DSNCALS- | STYWYRKKSGS- | TNEESISKG- | GRYVETVN-SGSKS- | FSLRINDLTVEDSGTYRCNV-WADS | | CPGELGR~ | YGGGTAVTVNA |
| 145 | 608742>A07 | ARVDQTPQTIKETGESLTINCVLR- | | DSNCALS- | NTYWYRKKSGS- | TNEESILKG- | GRYVETVN-SGSKS- | FSLRINDLTVLDGGTYRCNV-NS | | WSCEL~~~AYN~ | YGGGTVVTVNA |
| 146 | 608742>B02 | ARVDQTPQTIKETGESLTINCVLR- | | DSNCALS- | STYWYRKKSGS- | TNEESISKG- | GRYVETVN-SGSKS- | FSLRINDLTVEDSGTYRCNG- | | GSCNDD~~~SWY~ | YGGGTAVTVNA |
| 147 | 608742>B10 | ARVDQTPQTIKETGESLTINCVLR- | | DSNCALS- | STYWYRKKSGS- | TNEESISKG- | GRYVETVN-SGSKS- | FSLRINDLTVEDSGTYRCNT-S | | WFSYDCELD~~~V~ | YGGGTVVTVNA |

FIG. 1B1

|   | Clone ID | FW1 | * | CDR1 | FW2 | HV2 | FW2' | HV4 | FW3 | * | CDR3 | FW4 |
|---|---|---|---|---|---|---|---|---|---|---|---|---|
| 148 | 608742>E10 | ARVDQTPQIIKETGESLTINCVLR~DSNCALS~STYWYRKKSGS~TNEESISKG~GRYYETVN~SGSKS~FSLRINDLTVEDSGTYRCNV~ER~~~~~~~CRLNWSY~~~~~~~DV~YGGGTAVTVNA |
| 149 | 608742>F08 | ARVDQTPQIIKETGESLTINCVLR~DSNCALS~STYWYRKKSGS~TNEESISKG~GRYYETVN~SGSKS~FSLRINDLTVEDSGTYRCNG~PL~~~~~~~VCRG~~~~~~YNYDV~YGGGTAVTVNA |
| 150 | 623977>A11 | ARVDQTPQIIKETGESLTINCVLR~DSNCALS~STYWYRKKSGS~TNEESISKG~GRYYETVN~SGSKS~FSLRINDLTVEDSGTYRCNG~A~~~~~~~CYQ~~~~NWRH~~YDV~YGGGTAVTVNA |
| 151 | 623977>D03 | ARVDQTPQIIKETGESLTINCVLR~DSNCALS~STYWYRKNSGS~RNEESISLG~GRYYETVN~SGSKS~FSLRINDLTVEDSGTYGCNA~NS~~~~~~WSCEM~~~~AYNV~YGGGTAVTVNA |
| 152 | 623982>G07 | ARVDQTPQIIKETGESLTINCVLR~DSNCALS~STYWYRKKSGS~TNEESISKG~GRYYETVN~SGSKS~FSLRINDLTVEDSGTYRCRS~~~~~~~~~WYGDD~~~CR~T~~~~GGA~SGGGTAVTVNA |
| 153 | 623982>G09 | ARVDQTPQIIKETGESLTINCVLR~DSNCALS~STYWYRKKSGS~TNEESISKG~GRYYETVN~SGSKS~FSLRINDLTVEDSGTYRCKE~LVHRV~~~LEGCD~V~YGGGTAVTVNA |
| 154 | 623991>F02 | ARVDQTPQIIKETGESLTINCVLR~DSNCALS~STYWYRKKSGS~TNEESISKG~GRYYETVN~SGSKS~FSLRINDLTVEDSGTYRCKV~FET~~~~~DCPNNWR~~~~~~~V~YGGGTAVTVNA |
| 155 | 619043>C07 | ARVDQTPQIIKETGESLTINCVLR~DTNCALS~YTYWYRKKSGS~RNEENIWKG~GRYYETVN~SGSKS~FSLNINDLTVEDSGAYRCNA~HN~~~~~~MDCEL~~~~~~~AYNV~YGGGTAVTVNA |
| 156 | 637859>C05 | ARVDQTPQIIKETGESVINCVAR~DSNCALS~ATHWYRKKSGS~TNEENILKG~GRYYETVN~SGSKS~FSLRINDLTVEDSGTYRCNL~RET~~~~~~WPCWS~~~~~~~~PDV~YGGGTAVTVNA |
| 157 | 637859>F09 | ARVDQTPQIIKETGESLTINCVLR~DSNCALS~STYWYRKKSGS~TNEESISKG~GRYYETVN~SGSKS~FSLRINDLTVEDSGTYRCNV~F~L~~~~~~LGLIC~~~~~~T~~DDV~YGGGTAVTVNA |
| 158 | 637859>H08 | ARVDQTPQIIKETGESLTINCVLR~DSNCELS~STYWYRKKSGS~TNEARISKG~GRYYETVN~SGSKS~FSLRINDLTVEDSGTYRCNG~K~~~~~~~LVWLYDCP~~~~DV~YGGGTAVTVNA |
| 159 | 641310>H03 | ARVDQTPQIIKETGESLTINCVLR~DSNCALS~STYWYRKKSGS~TNEESISKG~GRYYETVN~SGSKS~FSLRINDLTVEDSGTYRCST~R~~~~~~~~~~~~~~~~~~CYTRTGPY~~~~DV~YGGGTAVTVNA |
| 160 | 641306>C01 | ARVDQTPQIIKETGESLTINCVLR~DTNCALS~STYWYRKKSGS~TDEESISKG~GRYYETVN~SGSKS~FSLRINDLSVEDSGTYGCKA~GRD~~~~~CSLYK~~~~~~~DDK~YGGGTAVTVNA |
| 161 | 641310>H10 | ARVDQTPQIIKETGESLTINCVLR~DSNCALS~STYWYRKKSGS~TNEESISKG~GRYYETVN~SGSKS~FSLRINDLTVEDSGTYRCPY~~~~~~~~~CRVAMTGV~~~PDV~YGGGTAVTVNA |
| 162 | 642375>B02 | ARVDQTPQIIKETGESLTINCVLR~DGNCALS~NIFWYRKKSGS~TNEDSISIG~GRYFETVK~RGSKS~LSLRINDLTVEDSGTYRCKY~PGD~~~~~SWRCT~~YDI~YGGGTAVTVNA |
| 163 | 642375>H11 | ARVDQTPQIIKETGESLTINCVLR~DSNCALS~STYWYRKKSGS~TNEESISKG~GRYYETVN~SGSKS~FSLRINDLTVEDSGTYRCNW~~~~~~~~~YQSGGW~~~~~~GN~~~DV~YGGGTAVTVNA |
| 164 | 606164>A07 | ARVDQTPQIIKETGESLTINCVLR~DSNCALS~STYWYRKKSGS~TNEESISKG~GRYYETVN~SGSKS~FSLRINDLTVEDSGTYRCNV~GCPNW~~~DPQYY~~~~~~~DV~YGGGTAVTVNA |
| 165 | 606164>D12 | ARVDQTPQIIKETGESLTINCVLR~DSNCALS~STYWYRKKSGS~TNEESISKG~GRYYETVN~SGSKS~FSLRINDLTVEDSGTYRCNV~YLCGL~~~ERY~~~~~~~NYDV~YGGGTAVTVNA |
| 166 | 606164>G02 | ARVDQTPQIIKETGESLTINCVLR~DSNCALS~STYWYRKKSGS~TNEESISKG~GRYYETVN~SGSKS~FSLRINDLTVEDSGTYRCNV~W~VIA~~~GIG~~~~~~~CNYDV~YGGGTAVTVNA |
| 167 | 606164>H04 | ARVDQTPQIIKETGESLTINCVLR~DSNCALS~STYWYRKKSGS~TNEESISKG~GRYYETVN~SGSKS~FSLRINDLTVEDSGTYRCNA~LYSWA~~~ECAGLDE~YGGGTAVTVNA |
| 168 | 608742>A03 | ARVDQTPRSVTKETGESLTINCVLR~DSNCALS~STYWYRKKSGS~TNEESISKG~GRYYETVN~SGSKS~FSLRINDLTVEDSGTYRCNV~LL~~~~~~CLVLN~~~~~~SN~~~YDV~YGGGTAVTVNA |
| 169 | 608742>A08 | ARVDQTPQIIKETGESLTINCVAR~DSNCALS~RTYWYRKKSGS~TNEESISKG~GRYYETVN~SGSKS~FSLRINDLTVEDSGTYRCNA~WY~~~~~~RPDC~~~EL~~~~DYDV~YGGGTAVTVNA |
| 170 | 608742>B06 | ARVDQTPQIIKETGESLTINCVAR~DSNCALS~RTYWYRKKSGS~TNEESISKG~GRYYETVN~SGSKS~FSLRINDLTVEDSGTYRCNA~~~~~~~~~DWSCAM~~NWRG~~~~V~YGGGTAVTVNA |
| 171 | 608742>H06 | ARVDQTPQIIKETGESLTINCVLR~DSNCALS~STYWYRKKSGS~TNEESISKG~GRYYETVN~SGSKS~FSLRINDLTVEDSGTYRCNV~LDT~~~~~DCGAGPP~~~~~~~~DV~YGGGTAVTVNA |

| | Clone ID | FW1 | CDR1 | FW2 | HV2 | FW2' | HV4 | FW3 | CDR3 | FW4 |
|---|---|---|---|---|---|---|---|---|---|---|
| 220 | 608742>D01 | ARVDQTPQTIIKETGESLTINCVLR | DSNCALS-STYWYRKKSGS | TNEESISKG | GRYIETVN | SGSKS-FSLRINDLTVEDSGTYRCNV | QLSSL---DCN---HDV | YGGGTAVTVNA |
| 221 | 608742>E01 | ARVDQTPQTIIKETGESLTINCVLR | DSNCALS-STYWYRKKSGS | TNEESISKG | GRYIETVN | SGSKS-FSLRINDLTVEDSGTYRCNV | QLSSL---DCN---HDV | YGGGTAVTVNA |
| 222 | 608742>F03 | ARVDQTPQTIIKETGESLTINCVLR | DSNCALS-STYWYRKKSGS | TNEESISKG | GRYIETVN | SGSKS-FSLRINDLTVEDSGTYRCNV-PPA | GRYEHCD---W---TGV | YGGGTVVTVNA |
| 223 | 619043>B12 | ARVDQTPQTIIKETGESLTINCVLR | DSNCALS-STYWYRKKSGS | TNEESISKG | GRYVETVN | SGSKS-FSLRINDLTVEDSGTYRCNV-F | PRW-GYDCG-TDL---DV | YGGGTAVTVNA |
| 224 | 619043>D09 | ARVDQTPQTIIKETGESLTINCVLR | DSNCALS-STYWYRKKSGS | TNEESISKG | GRYVETVN | SGSKS-FSLRINDLTVEDSGTYRCNV-W1A | GG---I---CLRGP---YDV | YGGGTAVTVNA |
| 225 | 619043>D11 | ARVDQTPQTIIKETGESLTINCVLR | DSNCALS-STYWYRKKSGS | TNTESISKG | GRYVETVN | SGSKS-FSLRINDLTVGDSGAYRCQI-WWN | IAGICG---GLSN---V | YGGGTVVTVNA |
| 226 | 619043>H08 | ARVDQTPQTIIKETGESLTINCVLR | DSNCALS-STYWYRKKSGS | TNEETISKG | GRYVETVN | SGSKR-FSLRINDLTVGDNGTYRCRV-WGS | YGGGLR---CS---NDV | YGGGTAVTVNA |
| 227 | 623977>B05 | ARVDQTPQTIIKETGESLTINCVLR | DSNCALS-STYWYRKKSGS | TNEESISKG | GRYVETVN | SGSKS-FSLRINDLTVEDSGTYRCNA-ES | WYQGTSRLGCD---V | YGDGTAVTVNA |
| 228 | 623977>C05 | ARVDQTPQTIIKETGESLTINCVLR | DSNCALS-STYWYRKKSGS | TNEESISKG | GRYVETVN | SGSKS-FSLRINDLTVEDSGTYRCNV | WAGYS-YDCGGW---REV | YGGGTAVTVNA |
| 229 | 623991>D09 | ARVDQTPQTIIKETGESLTINCVLR | DSNCALS-STYWYRKKSGS | TNEESISKG | GRYVETVN | SGSKS-FSLRINDLTVEDSGTYRCKA-A-G | YEFGCLN---WGNDV | YGGGTAVTVNA |
| 230 | 623991>F09 | ARVDQTPQTLIKETGESLTINCVLR | DSNCPLS-RTYWYRKKSGS | TNEESIKKG | GRYVETVN | RGSKS-FSLRINDLIVEDAGTYRCKL-HSLTG | YGCLR---DWDA | YGGGTAVTVNA |
| 230 | 641306>C05 | ARVDQTPQTIIKETGESLTINCVLR | DSNCALS-STYWYRKKSGS | TNEESISKG | GRYVETVN | SSLKS-FSLRINDLTVEDSGTYRCKG | VAICPMTAD-WFQBV---V | YGGGTVVTVNA |
| 232 | 641310>B08 | ARVDQTPQTIIKETGESLTINCVLR | DSNCALS-STYWYRKKSGS | TNEESISKG | GRYVETVN | SGSKS-FSLRINDLTVEDSGTYRCKV-YP | AGMS-YDCG---LY---DV | YGGGTVVTVNA |
| 233 | 642375>A01 | ARVDQTPQTIRVIGESLTINCVLR | DNNCAMS-NTYWFRKKSGS | TNEENISKG | GRYVETVN | TGSKS-FSLRINDLTVEDSGTYRCNV-RLR | GLWICLNW---HDA-DGDGTAVTVNA |
| 234 | 623977>H09 | ARVDQTPQTIIKETGESLTINCVLR | DSOCALS-STYFYRKKSGS | TNEESISKG | GRYVETVN | SESKS-FSLRINDLTVEDSGTYRCNV-GVRA | GPICL---GRG | YGDGTAVTVNA |
| 235 | 619043>E01 | ARVDQTPQTIIKETGESLTINCVLR | DSKCALS-STSWLRKKSGS | TNEESISKG | GRYVETVN | SGSKS-FSLRINDLTVEDSGTYRCGA-QCKAG | ASDWGLS---YDV | YGGGTVVTVNA |
| 236 | 606164>B05 | ARVDQTPQTIIKETGESLTINCVLR | DSNCALS-STYWYRKKSGS | TNEESISKG | GRYVETVN | SGSKS-FSLRINDLTVEDNGTYRCKT-QLV | WTVACGD---WRRDV | YGGGTAVTVNA |
| 237 | 606164>F05 | ARVDQTPQTIIKETGESLTINCVLR | DSNCALS-STYWYRKKSGS | TNEESISKG | GRYVETVN | SGSKS-FSLRINDLTVEDSGTYRCNV-Y-PA | GILYDC---RWMDDV | YGGGTAVTVNA |
| 238 | 606164>G09 | ARVDQTPQTIIKETGESLTINCVLR | DSNCALS-STYWYRKKSGS | TNEESISKG | GRYVETVN | SGSKS-FSLRINDLTVEDSGTYRCNV-YWHGS | LR---D---CASGLNV | YGGGTAVTVNA |
| 239 | 606164>G06 | ARVDQTPQTIIKETGESLTINCVLR | DSNCALS-STYWYRKKSGS | TNEESISKG | GRYVETVN | SGSKS-FSLRINDLTVEDSGTYRCNV-FAG | MDYDCG---LYNYDV | YGGGTAVTVNA |
| 240 | 608742>A12 | ARVDQTPQSIIKETGESLTINCVLR | DSNCALS-STYWYRKKSGS | TNEESISKG | GRYVETVN | SGSKS-FSLRINDLTVEDSGTYRCNV-AGRG | SYDCRTG---VYDV | YGGGTAVTVNA |
| 241 | 619043>D03 | ARVDQTPQTIIKETGESLTINCVLR | DSNCALS-STYWYRKKSGS | TNEESISKG | GRYVETVN | SGSKS-FSLRINDLTVEDSGTYRCNA-LVWEIC1 | TELEIRD---V | YGGGTAVTVNA |
| 242 | 623982>B12 | ARVDQTPQTIIKETGESLTINCVLR | DSNCALS-WTYWYRKKSGS | TNEESISKG | GRYVETVN | SGSKS-FSLRINDLTVEDSGTYRCKA-H | WDCALNWIP---ILYDV | YGGGTAVTVNA |
| 243 | 623991>H11 | ARVDQTPQTIIKETGESLTINCVLR | DSNCALS-NLYWYRKKSGS | TNEESISLG | GRYVETVN | SGSKS-FSLRINDLTVEDSGTYRCKG-RGR | ITHDCTG---VKYDV | YGGGTAVTVNA |

FIG. 1B5

| | Clone ID | FW1 | * | CDR1 | FW2 | HV2 | FW2' | HV4 | FW3 | * | CDR3 | FW4 |
|---|---|---|---|---|---|---|---|---|---|---|---|---|
| 244 | 637859>B06 | ARVDQTPQTIIKETGESLTINCVVR | - | DSNCAVT | -STYWYRKKSGS- | GRYVETVN | -SGSKS- | TNEEHISKG- | FSLRINDVTVEDSGTYRCNV | - | YAE----SIRPY---DCAY----FDP- | YGGGTAVTVNA |
| 245 | 641306>C07 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | I---YDCKLNWN----------R- | YGGTAVTVNA |
| 246 | 641310>H12 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKV | - | YLRAG----I---DCRLARR------DPVWG- | YDV-YGGGTAVTVNA |
| 247 | 642375>G02 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKT | - | LVWRWDCPELG--------- | YDV-YGGTAVTVNA |
| 248 | 606164>F09 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNS | - | I-------LVWRWDCPELG------- | YDV-YGGGTAVTVNA |
| 249 | 606164>G07 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | -SPRYDCG--------- | YEDV-YGGGTVTVNA |
| 250 | 606164>G10 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | -SDCETG---YGPYI------- | LRRDV-YGGGTVTVNA |
| 251 | 606164>G10 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | -LLVWI-----YGGY--------- | DCAPVDV-YGGGTVTVNA |
| 252 | 608742>B04 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | -YPSIA----GIGYDC--------- | YNYDV-YGGGTVTVNA |
| 253 | 608742>E12 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKA | - | -G----M-----D--YDCDNPRNWLY------- | DV-YGGGTAVTVNA |
| 254 | 619043>A10 | ARVDQTPQTIIKETGESLTINCVLR | - | DSNCALS | -STYWYRKKSAS- | GRYVETVN | -SGSKS- | TNEESISKG- | FSLRINDLTVEDSGTYRCNV | - | -FD----AGMGSYDWG-TAC--- | DV-YGGGTAVTVNA |
| 255 | 619043>H03 | ARVDQTPQTIIKETGESLTINCVLR | - | DSNCALS | -STYWYRKKSAS- | GRYVETVN | -SGSKS- | TNEESISKG- | FSLRINDLTVEDSGTYRCNV | - | -PVK----CGTTQ---TWRLA--- | YDV-YGGGTAVTVNA |
| 256 | 623977>A10 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | -PVK----CGTTQ---TWRLA--- | YDV-YGGGTAVTVNA |
| 257 | 623977>D06 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKS | - | -WYD---CPRYTAELV----I----- | SGV-YGGGTVTVNA |
| 258 | 623977>E10 | ARVDQTPQTIIKETGESLTINCVLR | - | DSNCALS | -STYWYRKKSGS- | GRYVETVN | -SGSKS- | TNEESISKG- | FSLRINDLTVEDSGTYRCNV | - | -LG----SYDCPEENY---- | PIYDV-YGGGTVTVNA |
| 259 | 623991>B06 | ARVDQTPQTIIKETGESLTINCVLR | - | DSNCALS | -STYWYRKKSGS- | GRYVETVN | -SGSKS- | TNEESISKG- | FSLRTNDLTVEDSGTYRCKV | - | -MSS-----QYDYEYCTHNYD---------V--- | YDV-YGDGTAVTVNA |
| 260 | 623991>D03 | ARVDQTPQTIIKETGESLTINCVLR | - | DSNCALS | -STYWYRKKSGS- | GRYVETVN | -SGSKS- | TNEESISKG- | FSLRINDLTLEDSGTYRCKS | - | -IC-------PSLSLYGTDHW--------- | YDV-YGGGTAVTVNA |
| 261 | 623991>E03 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKV | - | -TVW-----IGYDCGGN----WKDDV- | YGGGTAVTVNA |
| 262 | 641306>B10 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKV | - | -LGR-----ADCRVNWT------HNYDV- | YGGGTAVTVNA |
| 263 | 641306>F09 | ARVDQTPQTIIKEKGESLTINCVLR | - | DSECALS | -KTYWYHKKTGS- | GRYVETVN | -TNEDLVSKG- | -FSLRINDLRVEDSGTYRCKV | - | YRYYG-----FYYCLLG------- | DYDV-YGGGTVTVNA | |
| 264 | 641310>D01 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKA | - | -SG---V----CWYSQTGPGNYD----------V- | YGDGTAVTVNA |
| 265 | 641306>A03 | ARVDQTPQTIIKETGESLTINCVLR | - | DSNCALS | -STSWYRKKSSGS- | GRYVETVN | -SGSKS- | TNEESISKG- | FSLRINDLTVRDSGTYRCKS | - | -EL-----CLAMIGVFMD-------- | SHV-YGGGTAVTVNA |
| 266 | 641310>A08 | ARVDQTPQTIIKETGESLTINCVLR | - | DSNCALS | -STYWSRKKSSGS- | GRYVETAN | -SLEQS- | FSLRINDLTVEDSGTYRCKY | - | -WGIEE---DNCGRWRNCQGG-AGGGTVTVNA | | |
| 267 | 641310>G08 | ARVDQTPQTIIKETGESLTINCVLR | - | DSNCALS | -STYWYRKKSGS- | GRYVETVN | -SGSKS- | TNEESISKG- | FSLRINDLTVEDSGTYRCKT | - | -LFSGM-----LVCRSNWME-------- | DV-YGGGTVTVNA |

FIG. 1B6

| | Clone ID | FW1 | * | CDR1 | FW2 | HV2 | FW2' | HV4 | FW3 | * | CDR3 | | FW4 |
|---|---|---|---|---|---|---|---|---|---|---|---|---|---|
| 268 | 606164>H06 | ARVDQTPQTIIKETGESLTINCVLR-DSNCAFS-STYWYRKKSGS-RNEVRISKG-GRYVETVN-SGSKS-FSLRINDLTVEDSGTYRCNV-LDISY-DCVWKLD-----GSYDV-YGGGTAVTVNA |
| 269 | 606164>F08 | ARVDQTPQTIIKETGESLTINCVLR-DSNCALS-STYWYRKKSGS-TNEESISKG-GRYVETVN-SGSKS-FSLRINDLTVEDSGTYRCNV-LELVS-IRDD-----WYCNYDL-FGGGTAVTVNA |
| 270 | 608742>C07 | ARVDQTPQTIIKETGESLTINCVLR-DSNCALS-STYWYRKLSGS-TNEESISKG-GRYVETVN-SGSKS-FSLRINDLTVEDSGTYRCNV-YTTGT-V---YDCPLRGRS-----DV-YGGGTAVTVNA |
| 271 | 619043>B06 | ARVDQTPQTIIKETGESLTINCVLR-DSNCALS-STYWYRKLSGS-TNEESISKG-GRYVETVN-SGSKS-FSLRINDLTVEDSGTYRCNV-----WSRCWYTGLPEL-ESGV---YGGGTVTVNA |
| 272 | 623982>H08 | ARVDQTPQTIIKETGESLTINCVLR-DSNCALS-STYWYRKKSGS-TNQESISPG-GRYVETVN-SGSKS-FSLRINDLTVEDSGTYRCKV-SS-----SLVSSYDCGLDWS-----SQ-YGGGTVTVNA |
| 273 | 619043>A03 | ARVDQTPQTIIKETGESLTINCVLR-DSNCDLS-STYWYRKKSGS-TNEKNISKG-GRYVETVN-SGSKS-FSLRINDLTVEDSGTYRCKV-LIA-----AMGCHNYDSLL---EDV-YGGGTVTVNA |
| 274 | 637859>D04 | ARVDQTPQTIIKETGESLTINCVLR-DSNCALS-STYWYRKKSGS-TNEESISKG-GRYVETVN-SGSKS-FSLRINDLTVEDGGTYHCGV-TS-----SAA-RGDGTVTVNA |
| 275 | 637859>H03 | ARVDQTPQTIIKETGESLTINCVLR-DRNCALS-STYWYRKKSGS-TNEESISKG-GRYVETVN-SGSKS-FSLRINDLTVEDSGTYRCNV-YKGAH-----IAEDCELNWS-----DV-YGGGTAVTVNA |
| 276 | 641306>A10 | ARVDQTPQIMSKETGESLTINCLLR-DSNCVLS-STYWYRKKSGS-TNEETVSKG-GRYVETVN-SGSKS-FHLRINDLTVEDSGTYRCKV-SLG-----HSYDCPGNW-FGRDV-YGGGTVTVNA |
| 277 | 641310>C04 | ARVDQTPQTIIKETGESLTINCLLR-DSSCPLS-SGYWYRKKSDS-TNEENISKG-GRYVETVN-SGSKS-HSLRINDLTVEDSGTYRCKL-TTN-----SWTCIGHELAT-----KGV-YGGGTAVTVNA |
| 278 | 641310>D02 | ARVDQTPQTIIKETGESLTINCVLR-DSNCALS-STYWYRKKSGS-TNEESISKG-GRYVETVN-SGSKS-FSLRINDLTVEDSGTYRCKP-----SWYPGVCAGSNWRSHDV-YGGGTVTVNA |
| 279 | 641306>B02 | ARVDQTPQTIIKETGESLTINCVLR-DSNCALS-STYWYRKKSGS-TNEESISKG-GRYVETVN-SGSKS-FSLRINDLTVEDSGTYRCKV-FHGW-----YGCYDSRTGG----PDV-YGGGTVTVNA |
| 280 | 641306>B07 | ARVDQTPQTIIKETGESLTINCVLR-DSNCALS-STYWYRKKSGS-TNEESISKG-GRYVETVN-SGSKS-FSLRINDLTVEDSGTYRCKV-FD-----FWYPTNSYDCLEL----WG-HGGGTAVTVNA |
| 281 | 641310>C12 | ARVDQTPQTIIKETGESLTINCVLR-DSNCALS-STYWYRKKSGS-TNEESISKG-GRYVETVN-SGSKS-FSLRINDLTVEDSGTYRCKV-YLVG-----YDCAPSWAPV-----PDV-YGGGTAVTVNA |
| 282 | 642375>A03 | ARVDQTPQTIIKETGESLTINCVLR-DSNCALS-STYWYRKKSGS-TNEESISKG-GRYVETVN-SGSKS-FSLRINDLTVEDSGTYRCKV-DPIG-----GYSYAL-NWRC-----RDV-YGDGTAVTVNA |
| 283 | 642375>D08 | ARVDQTPQTIIKETGESLTINCVLR-DSNCALS-STYWYREKSGS-TNEESISKG-GRYVETVN-SGSKS-FSLRINDLTVEDSGTYRCNV-WIAGI-----HYDSERC-RYYD-----V-YGDGTAVTVNA |
| 284 | 642375>E07 | ARVDQTPRSVTKETGESLTINCVLR-DSICALS-STHWYRKKSGS-TNEESISKG-GRYVETVN-SGSKS-FSLRINDLTVEDSGTYRCNV-YP-----IAGICGT-GERNN-----YDV-YGGGTVTVNA |
| 285 | 623977>B11 | ARVDQTPQTIIKETGESLTINCVLR-DSNCALS-STYWYRKKSGS-TNEESISKG-GRYVETVN-SGSKS-FSLRINDLTVEDSGTYRCKV-RP-----LLPYGGYDCAVLG-----EEI-YGDGTVTVNA |
| 286 | 606164>B10 | ARVDQTPQTIIKETGESLTINCVLR-DSNCALS-STYWYRKKSGS-TNEESISKG-GRYVETVN-SGSKS-FSLRINDLTVEDSGTYRCNV-YLGAG-----IRYDCG-----DPLNYDV-YGDGTVTVNA |
| 287 | 608742>A05 | ARVDQTPQTIIKETGESLTINCVLR-DSNCALS-STYWYRKKSDS-TNEESISKG-GRYVETVN-SGSKS-FSLRINDLTVEDSGTYRCNV-WKK-----ACMIGYDCGLQAR-----DV-YGGGTVTVNA |
| 288 | 608742>A09 | ARVDQTPQTIIKETGESLTINCVLR-DSNCALS-STYWYRKKSGS-TNEESISKG-GRYVETVN-SGSKS-FSLRINDLTVEDSGTYRCNV-YRW-----AGMDPDDCDSDS-----TDV-YGGGTVTVNA |
| 289 | 608742>D09 | ARVDQTPQTIIKETGESLTINCVLR-DSNCALS-STYWYRKKSGS-TNEESISKS-GRYVETVN-SGSKS-FSLRINDLTVEDSGTYRCNV-YSSPS-----IYDCVRTGYN-----YDV-YGGGTVTVNA |
| 290 | 623977>F11 | ARVDQTPQTIIKETGESLTINCVLR-DSNCALS-STYWYRKKSGS-TNEESISKS-GRYVETVN-SGSKS-FSLRINDLTVEDSGTYRCKV-P-A-----FQEIVGRCFLDPS-----DDV-YGGGTVTVNA |
| 291 | 623991>H08 | ARVDQTPRSVTKETGESLTINCVLR-DSNCPLD-ATYWYRTIKKGS-TPEESISKG-GRYVETVN-SGSKS-FSLRINDLTVEDSGTLRCKV-FPRFG-----TGPGDCAFH-----QEDV-SGGGTVTVNA |

FIG. 1B7

| | Clone ID | FW1 | * | CDR1 | FW2 | HV2 | FW2' | HV4 | FW3 | * | CDR3 | FW4 |
|---|---|---|---|---|---|---|---|---|---|---|---|---|
| 292 | 641306>E04 | ARVDQTPQTITKETGESLTINCVLR~DSNCALS~TYWYRKKSGS~TNEESISKG~GRYVETVN~SGSKS~FSLRINDLTVEDSGTYRCKV~WSW~~~~~~~DIPSDMP~NWSCN~~~YDV~YGGGTVVTVNA |
| 293 | 641310>A07 | ARVDQTPQTITKETGESLTINCVLR~DSNCALS~STYWYRKKSGS~TNEESISKG~GRYVETVN~SGSKS~FSLRINDLTVEDSGTYRCKV~~~~~~~~WYCRRIYPGELNWDNYDV~~YGGGTAVTVNA |
| 294 | 641310>E08 | ARVDQTPQTITKETGESLTINCVLR~DSNCALS~STYWYRKKSGS~TNEESISKG~GRYVETVN~SGSKS~FSLRINDLTVEDSGTYRCQT~IFGMW~~~~~DQVC~IY~~~~~~GNSRYDV~YGGGTAVTVNA |
| 295 | 642375>C12 | ARVDQTPQTITKETGESLTINCVLR~DSNCPLD~ATYWYRKTKRDS~TNEETISIT~GRYVETVN~NEAKS~FSLRIYDLRSEDSGTLRCKV~FPRFG~~~~~TGPGSCAFY~~~~~~QEDV~YGDGTAVTVNA |
| 296 | 642375>E06 | ARVDQTPQTITKETGESLTINCVLR~DSNCALS~STYWYRKKSGS~TNEESISKG~GRYVETVN~SGSKS~FSLRINDLTVEDSGTYRCRV~~~~~~~WECRV~~~YDYGNE~LEIG~~~~~~LAV~YGDGTAVTVNA |
| 297 | 642375>E10 | ARVDQTPQTITKETGESLTINCVLR~DSNCALS~STYWYRKKSGS~TNEESISKG~GRYVETVN~SGSKS~FSLRINDLTVEDSGTYRCNV~W~~~~~~~~PRWYGTDCS~HELYNYDV~YGGGTVVTVNA |
| 298 | 619043>A04 | ARVDQTPQTITKETGESLTINCVLR~DSNCALA~STYWSRKKSGS~SNEESISKG~GRYVETVN~SGSKS~SSLRINDLTVEDSGTYWRCNV~FSSIT~~~KMYPFPSRVNCDD~~~~~~V~YGDGTAVTVNA |
| 299 | 606164>F06 | ARVDQTPQTITKETGESLTINCVLR~DSNCALS~STYWYRKKSGS~TNEESISTG~GRYVETVN~SGSKS~FSLRINDLTVEDSGTYRCNV~YRRGE~~~~LVGPYSR~~~~~~CELGSGV~YGGGTAVTVNA |
| 300 | 623991>C06 | ARVDQTPQTITKETGESLTINCVLR~DSNCALS~STYWYRKKSGS~TNEESISKG~GRYVETVN~SGSKS~FSLRINDLTVEDSGTYRCKV~P~~~~~~~AGIDPVYDCAGGNWPGDV~YGGGTAVTVNA |
| 301 | 623991>D04 | ARVDQTPQTITKETGESLTINCVLR~DSNCALS~STYWYRKKSGS~TNEESISKG~GRYVETVN~SGSKS~FSLRINDLTVEDSGTYRCKA~YGVWD~~~~~SCIGWRWGGQ~~~~~~YDV~YGDGTAVTVNA |
| 302 | 623991>G08 | ARVDQTPQTITKETGESLTINCVLR~DSNCALS~STYWYRKKSGS~TNEESISKG~GRYVETVN~SGSKS~FSLRINDLTVEDSGTYRCKV~STKLV~~~YYDCASPAYVG~~~~~~YDV~YGGGTAVTVNA |
| 303 | 641306>B11 | ARVDQTPQTITKETGESLTINCVLR~DSNCALS~STYWYRKKSGS~TNEESISKG~GRYVETVN~SGSKS~FSLRINDLTVEDSGTYRCKV~SGWYT~~~RGYDCRY~~NWSG~~~~~~DDV~YGDGTAVTVNA |
| 304 | 641310>D08 | ARVDQTPQTITKETGESLTINCVLR~DSNCALS~STYWYRKKSGS~TNEESISKG~GRYVETVN~SGSKS~FSLRINDLTVEDSGTYRCKV~LVRAG~~~~ASYDCAA~~~~~~PYE~YDV~YGGGTVVTVNA |
| 305 | 619043>C11 | ARVDQTPQTITKETGESLTINCVLR~DSNCALS~STYWYRKKSGS~TNEESISKG~GRYVETVN~SGSKS~FSLRINDLTVEDSGTYRCNV~WDH~~~~~~HSWYGSDSYDCRGI~~~GDV~YGGGTAVTVNA |
| 306 | 623991>D05 | ARVDQTPQTITKETGESLTINCVLR~DSNCALS~STYWYRKKSGS~TNEESISKG~GRYVETVN~SGSKS~FSLRINDLTVEDSGTYRCKV~YGR~~~~~~YSWYGSRDCELGSGDDV~YGGGTAVTVNA |
| 307 | 623982>E09 | ARVDQTPQTITKETGESLTINCVLR~DSNCTLS~STYWYRSASGS~TSEESISKG~GRYVETVN~SGSKS~FSLRINDLTVEDSGTYRCKV~LR~~~~~~~CMTDLYGLGAGGRGPLDV~YGGGTAVTVNA |
| 308 | 641310>H02 | ARVDQTPQTITKETGESLTINCVLR~DSNCALS~STYWYRKKSGS~TNEESISKG~GRYVETVN~SGSKS~FSLRINDLTVEDSGTYRCKV~YS~~~~~~~LVCRDDQLNWRGPTNYDV~YGGGTVVTVNA |
| 309 | 641310>H11 | ARVDQTPQTITKETGESLTINCVLR~DSNCALS~STYWYRKKSGS~TNEESISKG~GRYVETVN~SGSKS~FSLRINDLTVEDSGTYRCKV~LC~~~~~~~HSRWYPSMTASDWIMADV~YGGGTAVTVNA |
| 310 | 619043>H06 | ARVDQTPQTITKETGESLTINCVLR~DSNCALS~STYWYRKKSGS~TNEESISKG~GRYVETVN~SGSKS~FSLRINDLTVEDSGTYRCKV~SSGA~~~~~IAGAYDCAETGW~YNYDV~YGGGTAVTVNA |
| 311 | 641306>H07 | ARVDQTPQTITKETGESLTINCVLR~DSNCALS~STYWYRKKSGS~TNEESISKG~GRYVETVN~SGSKF~FSLRINDLTVEDSGYRCKV~PHRAD~~~SWCTGGDYDSNLGY~~~~~~YDV~YGDGTVVTVNA |
| 312 | 619043>A09 | ARVDQTPQTITKETGESLTINCVLR~DSNCALS~STYWYRKKSGS~TNEESISKG~GRYVETVN~SGSKS~FSLRINDLTVEDSGTYRCNV~MGSWY~~~TYDCDRGELNW~WTNNYDV~YGGGTAVTVNA |
| 313 | 623977>F02 | ARVDQTPQTITKETGESLTINCVLR~DSNCALS~STYWYRKKSGS~TNEESISKG~GRYVETVN~SGSKS~FSLRINDLTVEDSGTYRCKV~SLGPIYSWYGLPPQRYDCAS~~~~GLDV~YGGGTVVTVNA |
| 314 | 623977>D04 | ARVDQTPQTITKETGESLTINCVLR~DSNCALP~STYWYRKKSGS~TNEESISKG~GRYVETVN~SGSKS~FSLRINDLTVEDSGTYRCKV~~~~~~~~~MFLCVLDGEVAELDPLYDV~YGGGTVVTVNA |

FIG. 1B8

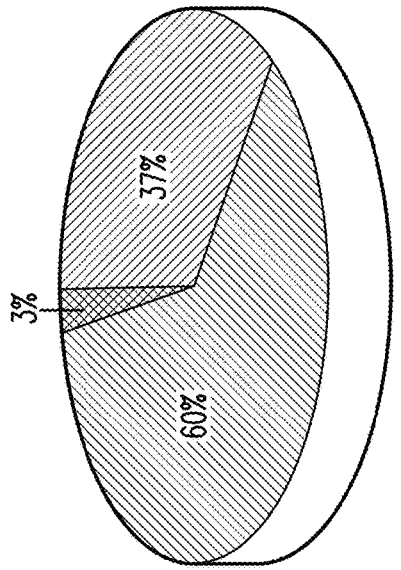
FIG. 3A
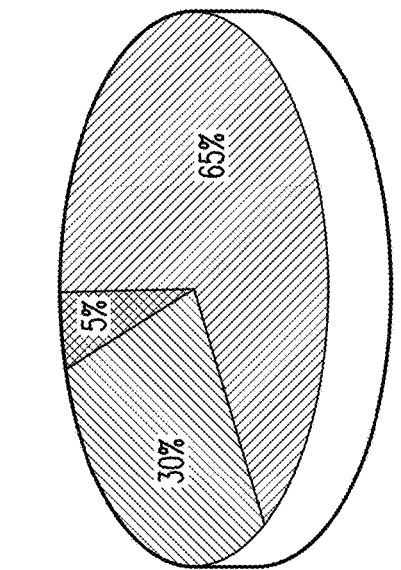
FIG. 3B
| CDR3 | 92 | 93 | 94 | 95 | 96 | 97 | 98 | 99 | 100 | 101 | 102 | FREQUENCY |
|---|---|---|---|---|---|---|---|---|---|---|---|---|
| | Y | G | G | G | T | V | V | T | V | N | A | 47% |
| | Y | G | G | G | T | A | V | T | V | N | A | 27% |
| | Y | G | D | G | T | A | V | T | V | N | A | 16% |
| | Y | G | D | G | T | V | V | T | V | N | A | 2% |
FIG. 3C

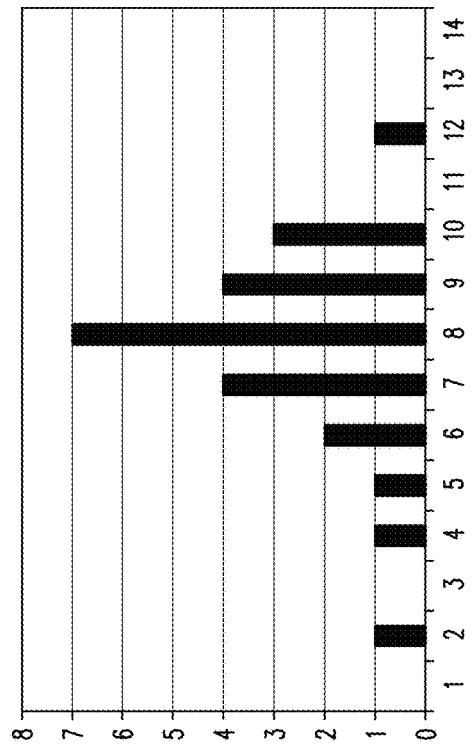
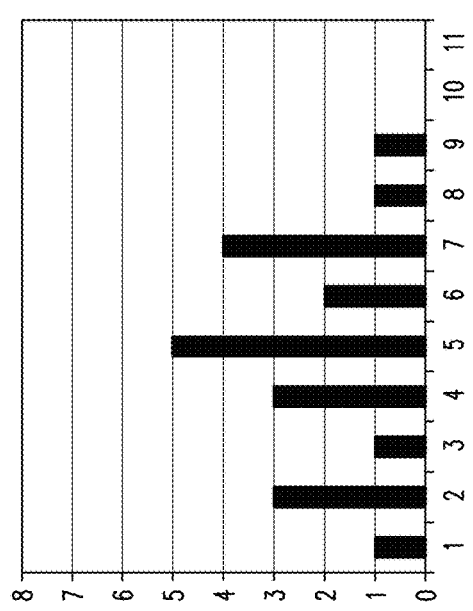
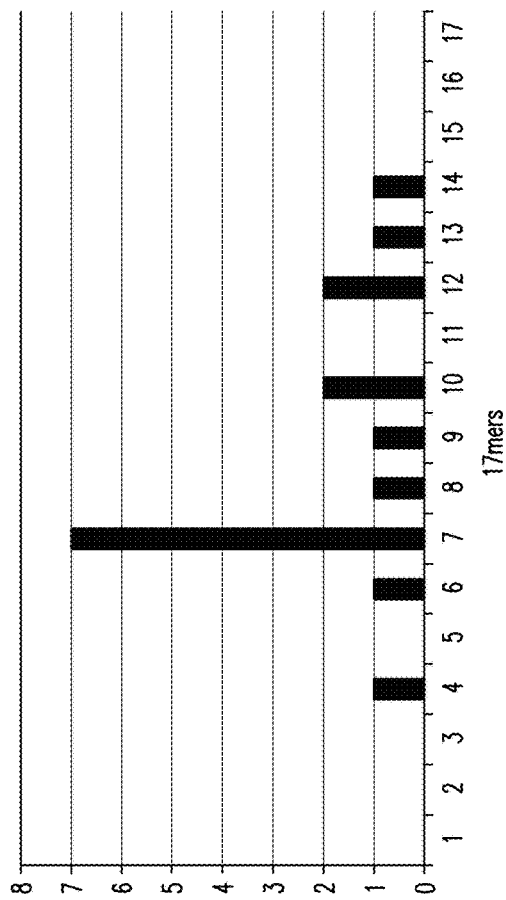
FIG. 4A
FIG. 4B
FIG. 4C

```
              CDR1                       HV2              HV4
          _____          _____      _____
         ARVDQTPQTITKETGESLTINCVLRDSNCALSSTYWYRKKSGSTNEESISKGGRYVETVNSGSKSFSLRINDLTVEDSGTYRC
VNAR_3   ........................................................................
VNAR_1   ..............................P.........D..............................
VNAR_2   ...........................I..D.R....................................K.
VNAR_4   ..............................N..T....N...........................V..
VNAR_5   ...RSV........................H.........N......................
VNAR_6   .................................NL...............K....................
VNAR_7   ...........................N.........N..L.............................
VNAR_8   ..............................E.....AR.................................
VNAR_9   .....V....................R.......L.T..................................K.
VNAR_10  ........................................................................
                                                         _____
                                                         100% conserved
```

|        | HV4                                                                                             |
|--------|-------------------------------------------------------------------------------------------------|
| VNAR_3 | AGCGGGATCAAAGTCCTTTTCTTTGAGAATTAATGATCTAACAGTTGAAGACAGTGGCACGTATCGATGC |
| VNAR_1 | AGCGGGATCAAAGTCCTTTTCTTTGAGAATTAATGATCTAACAGTTGAAGACAGTGGCACGTATCGATGC |
| VNAR_2 | AGCGGGATCAAAGTCCTTTTCTTTGAGAATTAATGATCTAACAGTTGAAGACAGTGGCACGTATCGATGC |
| VNAR_4 | AGCGGGATCAAAGTCCTTTTCTTTGAGAATTAATGATCTAACAGTGAAAGACAGTGGCACGTATCGATGC |
| VNAR_5 | AGCGGGATCAAAGTCCTTTTCTTTGAGAATTAATGATCTAACAGTTGAAGACAGTGGCACGTATCGATGC |
| VNAR_6 | AGCGGGATCAAAGTCCTTTTCTTTGAGAATTAATGATCTGTAGTTGAAGACAGTGGCACGTATCGATGC |
| VNAR_7 | AGCGGGATCAAAGTCCTTTTCTTTGAGAATTAATGATCTAACAGTTGAAGACAGTGGCACGTATCGATGC |
| VNAR_8 | AGCGGGATCAAAGTCCTTTTCTTTGAAAATTAATGATCTAACAGTTGAAGACAGTGGCACGTATCGATGC |
| VNAR_9 | AGCGGGATCAAAGTCCTTTTCTTTGAGAATTAATGATCTAACAGTTGAAGACAGTGGCACGTATCGATGC |
| VNAR_10| AGCGGGATCAAAGTCCTTTTCTTTGAAAATTAATGATCTAACAGTTGAAGACAGTGGCACGTATCGATGC |

100% conservation

FIG. 6B2

11mer

| | | | | | |
|---|---|---|---|---|---|
| CNV | $[X]_4$ | C | $[X]_4$ | DV | YGGGTA |
| CNV | $[X]_4$ | C | $[X]_4$ | DV | YGDGTA |
| CNV | $[X]_3$ | $[N/S/D/G/Y/C]_3$ | $[X]_3$ | DV | YGGGTV |
| CNV | $[X]_3$ | $[N/S/D/G/Y/C]_3$ | $[X]_3$ | DV | YGGGTA |
| CNV | $[X]_3$ | $[N/S/D/G/Y/C]_3$ | $[X]_3$ | DV | YGDGTA |

12mer

| | | | | | |
|---|---|---|---|---|---|
| CNV | $[X]_5$ | C | $[X]_4$ | DV | YGGGTV |
| CNV | $[X]_5$ | C | $[X]_4$ | DV | YGGGTA |
| CNV | $[X]_5$ | C | $[X]_4$ | DV | YGDGTA |
| CNV | $[X]_3$ | $[N/S/D/G/Y/C]_3$ | $[X]_4$ | DV | YGGGTV |
| CNV | $[X]_3$ | $[N/S/D/G/Y/C]_3$ | $[X]_4$ | DV | YGGGTA |
| CNV | $[X]_3$ | $[N/S/D/G/Y/C]_3$ | $[X]_4$ | DV | YGDGTA |

13mer

| | | | | | |
|---|---|---|---|---|---|
| CNV | $[X]_7$ | C | $[X]_3$ | DV | YGGGTV |
| CNV | $[X]_7$ | C | $[X]_3$ | DV | YGGGTA |
| CNV | $[X]_7$ | C | $[X]_3$ | DV | YGDGTA |
| CNV | $[X]_5$ | $[N/S/D/G/Y/C]_3$ | $[X]_3$ | DV | YGGGTV |
| CNV | $[X]_5$ | $[N/S/D/G/Y/C]_3$ | $[X]_3$ | DV | YGGGTA |
| CNV | $[X]_5$ | $[N/S/D/G/Y/C]_3$ | $[X]_3$ | DV | YGDGTA |

14mer

| | | | | | |
|---|---|---|---|---|---|
| CNV | $[X]_7$ | C | $[X]_4$ | DV | YGGGTV |
| CNV | $[X]_7$ | C | $[X]_4$ | DV | YGGGTA |
| CNV | $[X]_7$ | C | $[X]_4$ | DV | YGDGTA |
| CNV | $[X]_6$ | $[N/S/D/G/Y/C]_3$ | $[X]_3$ | DV | YGGGTV |
| CNV | $[X]_6$ | $[N/S/D/G/Y/C]_3$ | $[X]_3$ | DV | YGGGTA |
| CNV | $[X]_6$ | $[N/S/D/G/Y/C]_3$ | $[X]_3$ | DV | YGDGTA |

15mer

| | | | | | |
|---|---|---|---|---|---|
| CNV | $[X]_7$ | C | $[X]_5$ | DV | YGGGTV |
| CNV | $[X]_7$ | C | $[X]_5$ | DV | YGGGTA |
| CNV | $[X]_7$ | C | $[X]_5$ | DV | YGDGTA |
| CNV | $[X]_6$ | $[N/S/D/G/Y/C]_3$ | $[X]_4$ | DV | YGGGTV |
| CNV | $[X]_6$ | $[N/S/D/G/Y/C]_3$ | $[X]_4$ | DV | YGGGTA |
| CNV | $[X]_6$ | $[N/S/D/G/Y/C]_3$ | $[X]_4$ | DV |

16mer

| | | | | | | |
|---|---|---|---|---|---|---|
| CKV | | $[X]_7$ | C | $[X]_6$ | DV | YGGGTV |
| CKV | | $[X]_7$ | C | $[X]_6$ | DV | YGGGTA |
| CKV | | $[X]_7$ | C | $[X]_6$ | DV | YGDGTA |
| CKV | $[X]_3$ [N/S/D/G/Y/C] | $[X]$ [N/S/D/G/Y/C] | $[X]$ [N/S/D/G/Y/C] | $[X]_6$ | DV | YGGGTV |
| CKV | $[X]_3$ [N/S/D/G/Y/C] | $[X]$ [N/S/D/G/Y/C] | $[X]$ [N/S/D/G/Y/C] | $[X]_6$ | DV | YGGGTA |
| CKV | $[X]_3$ [N/S/D/G/Y/C] | $[X]$ [N/S/D/G/Y/C] | $[X]$ [N/S/D/G/Y/C] | $[X]_6$ | DV | YGDGTA |

17mer

| | | | | | |
|---|---|---|---|---|---|
| CKV | $[X]_6$ | C | $[X]_8$ | DV | YGGGTV |
| CKV | $[X]_6$ | C | $[X]_8$ | DV | YGGGTA |
| CKV | $[X]_6$ | C | $[X]_8$ | DV | YGDGTA |
| CKV | $[X]_6$ | $[N/S/D/G/Y/C]_3$ | $[X]_6$ | DV | YGGGTV |
| CKV | $[X]_6$ | $[N/S/D/G/Y/C]_3$ | $[X]_6$ | DV | YGGGTA |
| CKV | $[X]_6$ | $[N/S/D/G/Y/C]_3$ | $[X]_6$ | DV | YGDGTA |

18mer

| | | | | | |
|---|---|---|---|---|---|
| CKV | $[X]_{10}$ | C | $[X]_5$ | DV | YGGGTV |
| CKV | $[X]_{10}$ | C | $[X]_5$ | DV | YGGGTA |
| CKV | $[X]_{10}$ | C | $[X]_5$ | DV | YGDGTA |
| CKV | $[X]_8$ | $[N/S/D/G/Y/C]_3$ | $[X]_5$ | DV | YGGGTV |
| CKV | $[X]_8$ | $[N/S/D/G/Y/C]_3$ | $[X]_5$ | DV | YGGGTA |
| CKV | $[X]_8$ | $[N/S/D/G/Y/C]_3$ | $[X]_5$ | DV | YGDGTA |

```
13mers
C01-24..............................................................K........BVHKGDCD------LICD.....A...
C02-24.......D.R..................................................................LWGFSDYC------VVRD.....A...
C03-24.......E....AR..............................................................HVWTH.A---CH---MSD...D..A...
C04-24.......I....H...............................................................GT-FECWN.------LGAD.....
C12-24.......E....AR..............................................................WFRTIDDD------RLRD.....
C07-24.......E....AR..............................................................-AVWDTCL.G------ACD.....
C08-24.....N..T...................................................K...............LIGSST------ECPCG---D.....
C10-24.....N..T...AR..............................................................ASFIVDDYG------DD......A...
       D.R.

14mers
D01-24.......NL...L...............................................................L--RCSGBBCY------TCVD.....
D02-24..................................................................HRY.MAYDNCAK------D.....
D03-24.......E....AR..............................................................QYDLVVYG.------NNTD...D..A...
D04-24..............................................................................MDRSWRLCYSAL------D.....A...
D05-24........D....................................................K...............YH.EFLCPVKP------D.....A...
D07-24....V....L..T....R...........................................K...............VSGNVS----KCH--S-G-CD.....
D09-24.......P.........................................................HLBFLVMC.RBR------D.....
D11-24.......NL...L...............................................................L---IQLISGY------NVSD.....
D12-24....I....H...................................................K...............FRDED-LT.GKDG------D.....

15mers
E01-24.......L..T....R..............................................................--SISGFYGSD---A-VFCD......A...
E02-24.......L..T....R..............................................................DTLKLHFCLLE------KID......A...
E03-24....V..L..T....R..........................................K...............RIVTLT---FCDRMA-G---D.....A...
E04-24....V..L..T....R..........................................K...............ADQIV---INCPSDR-E--D...D..A...
E05-24.......L..T....R..........................................K...............DGLPCSYS.CP.------CD......D..A...
```

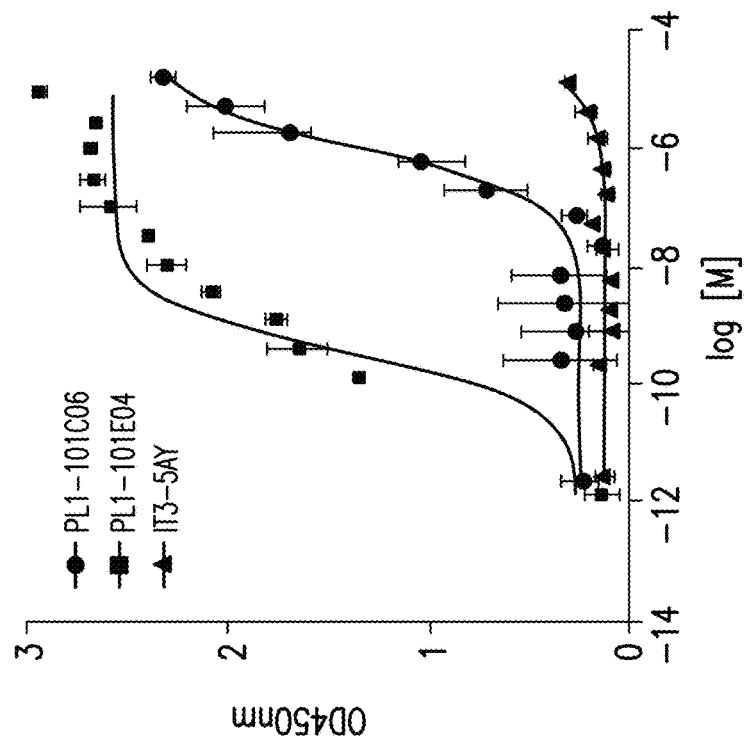
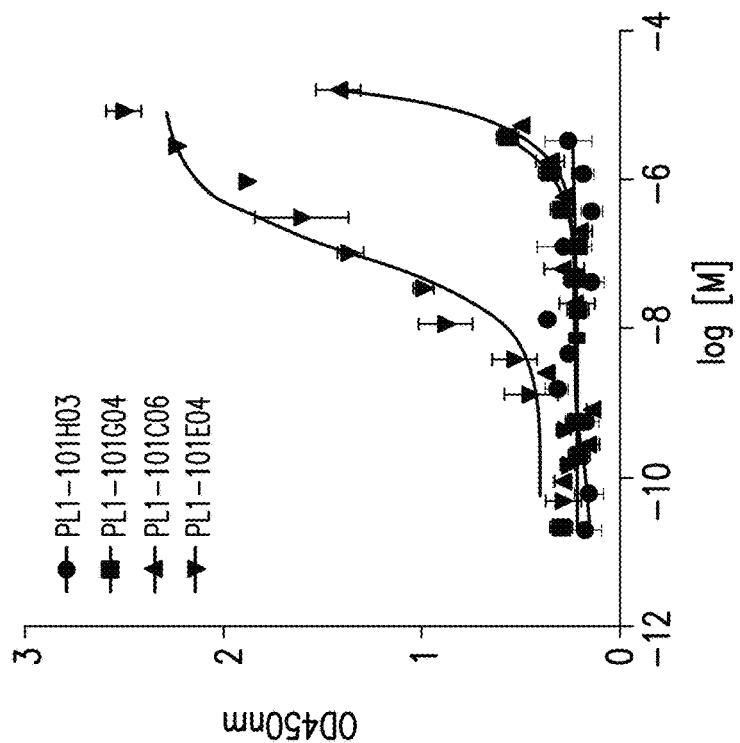
FIG. 19A
FIG. 19B

SEMI-SYNTHETIC NURSE SHARK VNAR LIBRARIES FOR MAKING AND USING SELECTIVE BINDING COMPOUNDS

CROSS REFERENCE TO RELATED APPLICATION

This PCT application is a national stage filing under 35. U.S.C. § 371 of Intl. Appln. No. PCT/US2015/038166, filed Jun. 26, 2015, which claims the benefit of provisional application U.S. Ser. No. 62/017,456, filed on Jun. 26, 2014, each of which is incorporated herein by reference in its entirety.

SEQUENCE LISTING

The instant application contains a Sequence Listing which has been filed electronically in ASCII format and is hereby incorporated by reference in its entirety. Said ASCII copy, created on Nov. 7, 2018, is named OSX1401-US2 SL.txt and is 533,046 bytes in size.

FIELD OF THE INVENTION

The present invention relates to VNAR single chain antibodies and more particularly, to semi-synthetic VNAR libraries derived from nurse shark which may be used to identify individual clones, nucleic acid molecules and polypeptide sequences which encode binding moieties that specifically bind to a cellular target of interest, thereby altering (e.g., antagonizing) target activity in a cell or mimicking the activity of a native molecule. The present invention thus also relates to antagonist compounds and compositions comprising a target specific VNAR binding moiety, methods for preparing them, and diagnostic and therapeutic methods of use relating to antagonism of the selected cellular target or target pathway e.g., to treat and/or prevent a pathological condition, disorder or disease in which it is beneficial to antagonize, reduce or eliminate the specific cellular target activity.

BACKGROUND OF THE INVENTION

Antibodies are essential tools for experimental research, diagnostics, and therapeutic applications. Monoclonal antibodies have revolutionized biotechnology and are now key therapeutic drugs in the treatment of human disease. Despite their successes, therapeutic monoclonal antibodies have certain limitations, such as restricted activity against certain types of antigen, poor tissue penetration, unwanted effector function in many situations, the cost of manufacturing, product instability and aggregation.

Conventional antibody molecules are composed of two heavy chain polypeptides linked to two light chain polypeptides by disulphide bridges. The combined variable regions of the heavy and light chains define the binding site by which the antibody interacts with its cognate antigen. In addition to these conventional antibodies, camelids and sharks produce another class of functional immunoglobulins, which are composed of heavy chains only. These heavy-chain only antibodies are naturally devoid of light chains, and can bind their cognate antigen using a single domain. The antigen binding surface of these single-chain antibodies is usually more convex (or protruding) than the one of conventional antibodies, which is usually flat or concave.

The identification of smaller binding proteins that retain high specificity and affinity for the target protein would be beneficial for access to hard-to-reach antigens. Single domain antibodies that occur naturally in the shark are particularly attractive for the development of next generation biotherapeutics. IgNARs (Immunoglobulin New Antigen Receptors) heavy chain-only Ig-like molecules have been identified in all species of sharks studied so far. They are disulphide-bound homodimeric molecules composed of two polypeptide chains containing five constant domains and one variable region (VNAR) by which they bind antigens (Greenberg et al., Nature 1995 Mar. 9; 374(6518):168-73).

VNARs are small (12 kDa), stable, soluble, monomeric antigen-binding domains that can be configured into many different therapeutic modalities. The isolation of various VNAR based binding moieties has been described (see, e.g., WO2003/014161 and WO2005/118629). Owing to their elongated CDR3 structures that potentially extend into antigen clefts and cavities, VNARs are well suited to the purpose.

The VNAR protein scaffold consists of amino acid residues (aa) 1-25 of the framework 1 (FW1) region; aa 26-32 of the complimentary determining region 1 (CDR1); aa 33-43 of FW2; aa 44-52 of the hypervariable 2 region (HV2); aa 53-85 of FW3; aa 61-65 of HV4; the CDR3 region (of variable length) and FW4 (11 residues starting at XGXG); see FIGS. 1A and B. Like all immunoglobulin family variable (V) domains, VNARs contain the two canonical cysteine residues that link FW1 and FW3 via a disulfide bond. Additionally, VNARs contain non-canonical cysteines which define two different structural isotypes. Type 1 VNARs contain two cysteine residues in CDR3, which form disulphide bridges to non-canonical cysteine residues in FW2 and FW4. In addition, Type 1 VNARs may also contain an even number of extra cysteines in CDR3, which form intraloop cysteine bridges. Type 2 VNARs contain only a single extra disulphide bond, which links CDR1 and CDR3. (FIG. 1A)

Regardless of the VNAR isotype, CDR1 and CDR3, and to a lesser extent HV2 and HV4, show a high level of sequence variability and are considered the major determinants for antigen binding. Some clones however, were shown to recognize their cognate antigen by also making a number of contacts outside of the CDRs. A high-affinity human serum albumin (HSA)-binding VNAR isolated from spiny dogfish, for example, was shown to interact with HSA in an atypical manner by making several framework contacts in addition to contacts to CDRs (Kovalenko et al. J Biol Chem. 2013 Jun. 14; 288(24):17408-19).

In order to circumvent the limitations of developing VNARs in living animals, several synthetic phage display libraries have been generated based on VNAR backbones from different shark species (see e.g., Nuttall et al., Eur J Biochem. 2003 September; 270(17):3543-54; Shao et al., Mol Immunol. 2007 January; 44(4):656-65. Epub 2006 Feb. 24). All these libraries, however, are based on CDR3 randomization of a single VNAR clone. It would thus be beneficial to have new VNAR libraries characterized by higher overall sequence diversity through CDR randomization in the context of a plurality of VNAR framework sequences from which high affinity binding proteins to molecular targets may be selected.

SUMMARY OF THE INVENTION

The present invention provides semi-synthetic VNAR libraries derived from nurse shark which may be used to identify individual clones, nucleic acid molecules and polypeptide sequences which encode binding moieties that specifically bind to a molecular or cellular target of interest, thereby antagonizing target activity in a cell or mimicking the activity of a native molecule. The present invention also provides antagonist compounds and compositions comprising a target specific VNAR binding moiety, methods for preparing them, and diagnostic and therapeutic methods of use relating to antagonism of the selected mammalian molecular or cellular target or target pathway e.g., to treat and/or prevent a pathological condition, disorder or disease in which it is beneficial to antagonize, reduce or eliminate the specific cellular target activity.

The present invention provides two classes of new semi-synthetic VNAR libraries based on nurse shark framework sequences. The first class is a Type 2 VNAR library which incorporates a number of selected backbone mutations in addition to CDR3 partial randomization for increased diversity. The second class is a Type 1 VNAR library, which is based on a more limited number of frameworks biased for very long CDR3 regions. Libraries of the invention comprise synthetic polypeptide compositions and/or nucleic acid molecules encoding them and may be used in assays, e.g., in phage display libraries, to identify and select sequences within the synthetic library which bind selectively to one or more molecular mammalian target molecules of interest. Libraries of the invention enable the generation of novel therapeutic products, in particular, specific binding moieties which bind selectively and with high affinity to a select cellular target, thereby producing a target antagonist compound or mimicking the activity of a native molecule. Exemplary binding moieties and molecular target antagonist compounds which may be identified and isolated using the semi-synthetic libraries of the invention include, inter alia, high affinity polypeptide binding domains specific for human BAFF, human transferrin receptor hTrR-1 and myostatin.

Accordingly, in certain embodiments, the present invention provides a composition comprising 50 or more semi-synthetic polypeptides, with each polypeptide comprising Type 2 VNAR framework (FW), hypervariable (HV) and complementary determining region (CDR) regions having a domain structure, from N- to C-terminal of FW1-CDR1-FW2-HV2-FW2'-HV4-FW3-CDR3-FW4, wherein within the composition, polypeptides will have amino acid residues at a given position X according to one or more of (a)-(h):

(a) framework domain FW1 comprises an amino acid sequence (SEQ ID NO: 1) A-R-V-D-Q-T-P-$X_1$-$X_2$-$X_3$-T-K-E-T-G-E-S-L-T-I-N-C-V-L-R wherein $X_1$=Q or R; $X_2$=T or S; and $X_3$=I or V;

(b) CDR domain CDR1 comprises an amino acid sequence (SEQ ID NO: 2) D-$X_4$-$X_5$-C-$X_6$-L-$X_7$ wherein $X_4$=S or N; $X_5$=N or I; $X_6$=A, D or E; and $X_7$=S or P;

(c) framework domain FW2 comprises an amino acid sequence: (SEQ ID NO: 3) $X_8$-$X_9$-$X_{10}$-W-Y-R-$X_{11}$-K-S-$X_{12}$-S wherein $X_8$=S, R, T or N; $X_9$=T or L; $X_{10}$=Y, H or L; $X_{11}$=K or T; and $X_{12}$=G or D;

(d) hypervariable region HV2 comprises an amino acid sequence: (SEQ ID NO: 4) $X_{13}$-N-E-$X_{14}$-$X_{15}$-I-S-$X_{16}$-G wherein $X_{13}$=T or R; $X_{14}$=E or A; $X_{15}$=S, N or R; and $X_{16}$=K or L;

(e) framework domain FW2' comprises an amino acid sequence: (SEQ ID NO: 5) G-R-Y-V-E-T-V-N;

(f) hypervariable region HV4 comprises an amino acid sequence: SGSKS (SEQ ID NO: 6);

(g) framework domain FW3 comprises an amino acid sequence: F-S-L-$X_{17}$-I-N-D-L-$X_{18}$-V-$X_{19}$-D-S-G-T-Y-R-C-$X_{20}$-V (SEQ ID NO: 7)

wherein $X_{17}$=R or K; $X_{18}$=T or V; $X_{19}$=E or K; and $X_{20}$=N or K;

(h) framework domain FW4 comprises an amino acid sequence: Y-G-$X_{21}$-G-T-$X_{22}$-V-T-V-N-A (SEQ ID NO: 8)

wherein $X_{21}$=G or D; and $X_{22}$=V or A;

and wherein CDR3 comprises or consists essentially of an amino acid sequence of from 7 to 25 amino acid residues partially randomized compared to germline Type 2 VNAR sequences which mediate specific binding of the polypeptide to a target molecule of interest. In embodiments of the compositions produced by a phage display library, the composition can have from 100 to $10^{10}$ polypeptides as determined by the phage titer. In some embodiments of the invention, the parts (a)-(h) consist essentially of the indicated amino acids. In some embodiments of the invention, the parts (a)-(h) consist of the indicated amino acids.

In certain embodiments, the invention provides a composition comprising a plurality of synthetic polypeptides, each synthetic polypeptide comprising a VNAR Type 2 backbone amino acid sequence: (SEQ ID NO: 9)

ARVDQTPX$_1$X$_2$X$_3$$^{(10)}$TKETGESLTI$^{(20)}$
NCVLRDX$_4$X$_5$CX$_6$$^{(30)}$LX$_7$X$_8$X$_9$X$_{10}$WYR X$_{11}$
K$^{(40)}$SX$_{12}$SX$_{13}$NEX$_{14}$X$_{15}$IS$^{(50)}$
X$_{16}$GGRYVETVN$^{(60)}$SGSKSFSLX$_{17}$I$^{(70)}$
NDLX$_{18}$VX$_{19}$DSG T$^{(80)}$YRCX$_{20}$V$^{(85)}$-[ . . .
CDR3 . . . ]-YGX$_{21}$GTX$_{22}$VTVNA wherein amino acid compositions at each position X are:

$X_1$=Q and R, with R being present in more than 4.4% of the polypeptides;

$X_2$=T and S, with S being present in more than 5.4% of the polypeptides;

$X_3$=I and V, with V being present in more than 4.4% of the polypeptides;

$X_4$=S and N $X_5$=N and I, with I being present in more than 3.2% of the polypeptides;

$X_6$=A, D and E, with D being present in more than 3.2% of the polypeptides and E being present in more than 2.2% of the polypeptides;

$X_7$=S and P, with P being present in more than 2.1% of the polypeptides;

$X_8$=S, R, T and N, with T being present in more than 1% of the polypeptides, and N being present in more than 5.3% of the polypeptides;

$X_9$=T and L, with L being present in more than 1.1% of the polypeptides;

$X_{10}$=Y, H and L, with H being present in more than 2.1% of the polypeptides and L being present in more than 2.1% of the polypeptides;

$X_{11}$=K and T, with T being present in more than 4.4% of the polypeptides;

$X_{12}$=G and D, with D being present in more than 4.4% of the polypeptides;

$X_{13}$=T and R, with R being present in more than 5.3% of the polypeptides;

$X_{14}$=E and A, with A being present in more than 1.1% of the polypeptides;

$X_{15}$=S, N and R, with R being present in more than 3.2% of the polypeptides;

$X_{16}$=K and L, with L being present in more than 3.2% of the polypeptides;

$X_{17}$=R and K, with K being present in more than 3.2% of the polypeptides;

$X_{18}$=T and V, with V being present in more than 3.2% of the polypeptides;

$X_{19}$=E and K, with K being present in more than 1.1% of the polypeptides;

$X_{20}$=N and K;

$X_{21}$=G and D; and $X_{22}$=V and A;

and wherein the [ . . . CDR3 . . . ] region of each polypeptide comprises 7 to 25 amino acid residues partially randomized compared to germline Type 2 VNAR sequences which mediate specific binding of the polypeptide to a target molecule of interest. Examples of [ . . . CDR3 . . . ] regions are shown in FIG. 7.

In either of the above embodiments based on semi-synthetic Type 2 VNAR sequences, the CDR3 region of each synthetic polypeptide may vary in length from 7 to 25 amino acid residues, from 9 to 20 amino acid residues and often from 11 to 18 amino acid residues in length. In certain embodiments, the CDR3 region of a semi-synthetic Type 2 VNAR of the invention is also characterized by containing a single cysteine residue (FIG. 1A). In addition, amino acid residues "DV" are predominantly (but not necessarily) found at the last two positions of a CDR3 of the invention (FIG. 1B; FIG. 4).

In yet another embodiment, the present invention provides a composition comprising 50 or more synthetic polypeptides, each synthetic polypeptide comprising a VNAR Type 1 framework (FW), hypervariable (HV) and complementary determining region (CDR) domain structure, from N- to C-terminal: FW1-CDR1-FW2-HV2-FW2'-HV4-FW3-CDR3-FW4; wherein at least 75% of the functional Type 1 VNARs comprise a CDR3 region of 26 amino acid residues or more, wherein a functional VNAR is non-frameshifted relative to the germline Type 1 VNAR sequence. In certain embodiments, the CDR3 region of a semi-synthetic Type 1 VNAR of the invention is characterized by containing two cysteine residues, which form disulphide bridges to non-canonical cysteine residues in FW2 and FW4. In addition, Type 1 VNARs may also contain an even number of extra cysteines in CDR3, which form intraloop cysteine bridges (FIG. 1A).

In certain embodiments, synthetic polypeptides and compositions of the invention may further comprise at least one engrafted HV2, HV4, CDR1 or CDR3 domain obtained from a heterologous antibody directed to a select mammalian molecular target. In such a case, the structural integrity of the engrafted molecule may be maintained by inserting cysteine residues in either CDR1 or CDR3 to restore the non-canonical cysteine bridge; or by deleting cysteine residues in either CDR1 or CDR3 to abolish the non-canonical cysteine bridge. Similarly, synthetic polypeptides within compositions of the invention may comprise at least one engrafted domain FW1, FW2, FW2', FW3 or FW4 obtained from a heterologous antibody directed to a select molecular target. In certain embodiments, one or more heterologous antibody domain engraftments are designed into a VNAR domain template in the process of generating a library of the invention. In certain embodiments, one or more heterologous antibody domains are engrafted into polypeptide(s) after such polypeptides are identified, selected or isolated from a semi-synthetic VNAR library of the invention to further refine characteristics of the binding moiety, e.g., to increase affinity or selectively of the moiety for a molecular target. Embodiments relating to heterologous antibody domain grafting may be performed individually or in any combination and are not intended to be mutually exclusive.

In another embodiment, the present invention provides a nucleic acid composition, e.g., a nucleic acid library, comprising a plurality of nucleic acid molecules encoding a polypeptide composition of the invention. In certain embodiments, the invention provides a library of phage or phagemid particles displaying a plurality of polypeptides of the invention. In certain embodiments, a nucleic acid library of the invention comprises from $0.5 \times 10^2$ to $2 \times 10^{10}$ or more molecules having distinct nucleic acid sequences (the upper limit being based on obtainable phage titers). A nucleic acid molecule of the invention or a fragment thereof may be inserted into or used to engineer a vector, e.g., an expression vector which is capable of producing in an appropriate host cell a polypeptide or polypeptide composition of the invention. In yet another embodiment, the invention provides a composition of vectors such as expression vectors comprising a plurality of nucleic acid molecules encoding a plurality of polypeptides of the invention. Host cells comprising a vector or composition of vectors of the invention are also provided.

Methods for identifying a polypeptide which binds selectively to a target molecule of interest are also provided. In certain embodiments, the invention provides a method for identifying molecular target specific binding moieties by expressing a library of phage or phagemid particles and exposing expression products to a target molecule of interest or an antigen thereof under conditions suitable for binding of the particles to the target antigen; and separating the particles that bind from those that do not bind to the target antigen.

Accordingly, the present invention further provides a method of identifying a polypeptide that binds selectively to a target molecule of interest, the method comprising the steps of: a) exposing a target molecule of interest to a composition comprising a plurality of polypeptides of the invention (or by expression of a nucleic acid molecule or composition of the invention); and b) separating polypeptides that selectively bind from those that do not selectively bind the target molecule. In certain embodiments, a target molecule of interest is expressed on the surface of a phage, bacterium or cell, or is attached to, tethered to or otherwise associated with a solid support.

In certain embodiments, a method of the invention may further comprise a step of: c) identifying high affinity binders from the polypeptide binders, wherein high affinity binders have an affinity of from about 0.1 nM to 250 nM, 1 nM to 250 nM, 10 nM to 250 nM, 50 nM to 250 nM, 100 nM to 250 nM, 0.1 nM to 100 nM, 1 nM to 100 nM, 10 nM to 100 nM, 50 nM to 100 nM, 0.1 nM to 50 nM, 1 nM to 50 nM, 5 nM to 50 nM, 10 nM to 50 nM, 0.1 nM to 25 nM, 1 nM to 25 nM, 5 nM to 25 nM, or 10 nM to 25 nM.

In certain embodiments, the present invention further provides a method of screening a library of the invention for a polypeptide that selectively binds with high affinity to a target molecule of interest, the method comprising the steps of: a) incubating a sample of the library with a concentration of a target molecule under conditions suitable for specific binding of the polypeptides to the molecule; b) incubating a second sample of the library under the same conditions but without target molecule; c) contacting each of the first and second sample with immobilized target molecule under conditions suitable for binding of the polypeptide to the immobilized target antigen; d) detecting the polypeptide bound to immobilized target molecule for each sample; and e) determining the affinity of the polypeptide for the target molecule by calculating the ratio of the amounts of bound polypeptide from the first sample over the amount bound polypeptide from the second sample.

Semi-synthetic polypeptides of the invention which selectively bind a molecular target molecule of interest are useful alone or as a component of a novel compound which can regulate cellular signaling pathways or alter (e.g., enhance or inhibit) molecular interactions mediated by the target molecule by virtue of its selective binding to the target molecule. Accordingly, in certain embodiments, the invention provides molecular target regulatory compounds (MTRCs), e.g., molecular target antagonist compounds (MTACs) comprising a polypeptide of the invention, and derivatives thereof. Binding of a MTRC or MTAC to its molecular target molecule alters target activity in a cell by interfering with, enhancing or blocking interactions between the target molecule and its natural ligands or binding partners, e.g., receptors or receptor subunits, which mediate cell signaling and/or regulation of biochemical pathways in a cell.

In certain embodiments of the invention, a molecular target binding moiety polypeptide, or a MTRC or MTAC comprising it, may be engineered to further refine characteristics of the target binding moiety, e.g., to alter, increase or reduce affinity, selectively or other binding characteristics of the binding moiety with its molecular target. Embodiments relating to heterologous antibody domain grafting to produce a library may alternatively or additionally be performed individually on a polypeptide of the invention. Accordingly, in certain embodiments, one or more heterologous antibody domains are engrafted or amino acid sequences used to further engineer a synthetic Type 1 or Type 2 VNAR polypeptide(s) of the invention to refine and improve its target binding properties.

The present invention further provides fusion polypeptides comprising a synthetic polypeptide of the invention and a heterologous polypeptide sequence. In certain embodiments, a fusion polypeptide of the invention is a hybrid comprising a polypeptide selected from a library of the invention, or a fragment thereof having binding activity, to a target molecule and one or more heterologous polypeptides, polypeptide fragments or chemical moiety to provide additional function, e.g., a therapeutic or diagnostic agent and/or increased solubility, stability or activity of the polypeptide in vitro or in vivo. Examples of useful fusion domains include but are not limited to antibody effector domains such as Fc domains.

The present invention also provides a nucleic acid molecule comprising a nucleotide sequence encoding a target specific binding moiety polypeptide, MTRC or MTAC of the invention or a fragment thereof comprising a target specific binding moiety, and a nucleic acid molecule comprising a nucleotide sequence complementary thereto.

The present invention provides pharmaceutical compositions comprising a polypeptide, MTRC or MTAC of the invention which comprises a synthetic VNAR target specific binding moiety of the invention and a pharmaceutically acceptable carrier.

Polypeptides, nucleic acid molecules, and various compositions comprising them, will be useful in a variety of methods, including, inter alia, as therapeutics for treating conditions, diseases or disorders which may be ameliorated by binding to and antagonizing or altering the bioactivity of a select molecular target molecule, and as diagnostic tools by virtue of their potential small size and high affinity binding characteristics.

BRIEF DESCRIPTION OF THE DRAWINGS

FIGS. 1B1-1B8 show an amino acid sequence alignment of 188 Type 2 VNAR sequences (SEQ ID NOS 127-314, respectively, in order of appearance and by left most column) derived from nurse shark. The sequences were aligned using the BioEdit® software. The schematic aligns four framework regions (FW1, FW2, FW3 and FW4) interspersed by CDR1, HV2, HV4 and CDR3 hypervariable regions of each sequenced clone. The two cysteine residues in FW1 and FW3 that form a canonical disulphide bond are indicated by asterisks above the amino acid positions (Example 1).

FIG. 3 shows the sequence variability on CDR3 edges. A: Amino acid composition at position 84 in "short" CDR3s (less than 16 amino acids) was N in 65% and K in 30% of clones. B: Amino acid composition at position 84 in "long" CDR3s (16 amino acids or more) was N in 37% and K in 60% of the clones. C: Frequency of each amino acid permutations at positions 94 and 97 observed in the set of analysed Type 2 VNARs. FIG. 3C discloses SEQ ID NOS 315-318, respectively, in order of appearance.

FIGS. 4A-C show the cysteine content at each position for three representative CDR3 regions by length category. 11mer (n=21), 14mer (n=24), 17mer (n=17).

FIG. 6 shows Type 2 VNAR templates for OsX-3 library generation. A: Protein sequence (up to just before CDR3) (SEQ ID NOS 319-328, respectively, in order of appearance) of the ten templates used to build the semi-synthetic library. CDR1, HV2, HV4, and the 100% homology stretch are indicated; B1 and B2: Corresponding DNA sequence and annotations of the 10 templates (SEQ ID NOS 329-338, respectively, in order of appearance).

FIGS. 7A and 7B show CDR3 architecture for each CDR3 length of the OsX-3 library (SEQ ID NOS 339-386, respectively, in order of appearance). For each chosen CDR3 length, a set of 6 oligonucleotides was designed to incorporate both randomization of the CDR3 and specific point mutations in the CDR3 edges (Bold=CDR3 region; X=any of the 20 amino acids).

FIG. 8A-8D show an alignment of OsX-3 sequences (SEQ ID NOS 222 and 387-472, respectively, in order of appearance). Sequences of clones randomly selected in the final OsX-3 library were sorted by CDR3 length and aligned to the VNAR_3 template (which represents the Type 2 consensus). Sequence identity with the latter is displayed as a dot. Clones highlighted in grey express a potentially unstable VNAR (Example 3).

Figure 9:
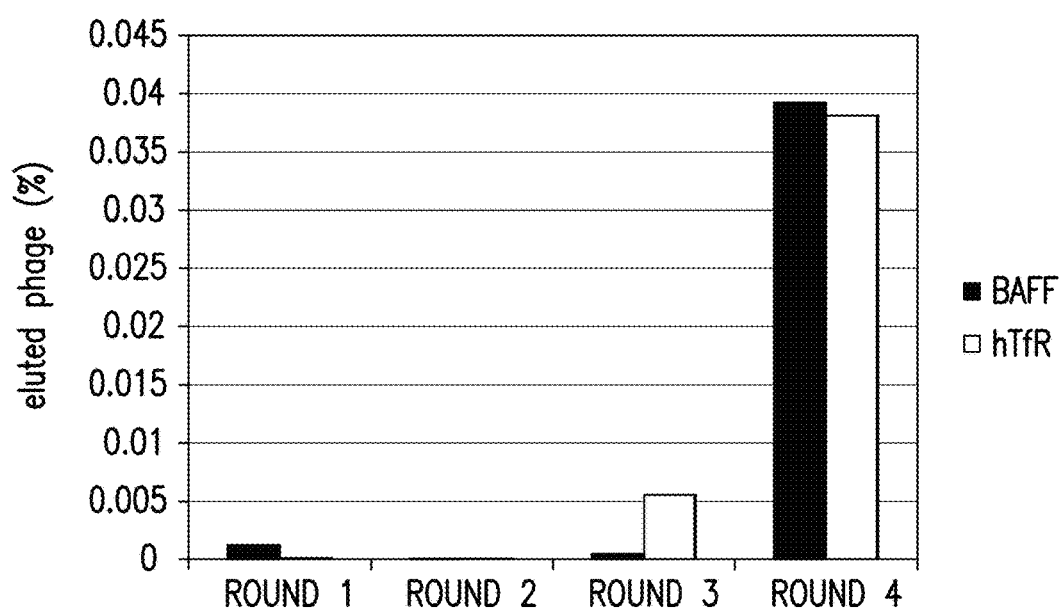

FIG. 9 shows the percentage of eluted phage after each round of selection from the OSX-3 library (Example 4). The number of phages eluted from the BAFF- and hTfR-coated wells after each round of selection is indicated as a percentage of the amount of phages that were incubated on the plate.

FIG. 10 shows OsX-3 selection outputs after screening for binding clones. A: 18 independent clones (based on their DNA sequence) were selected for binding specifically to human BAFF in a periprep ELISA format (threshold=four times HSA binding). B: 40 independent clones (based on their DNA sequences) were selected for binding specifically to human hTfR in a phage ELISA format (threshold=four times HSA binding) (Example 4).

Figure 11:

FIG. 11 shows Type 1 VNARs (SEQ ID NOS 473-475, respectively, in order of appearance) harbouring extended CDR3s (Example 5).

Figure 12:
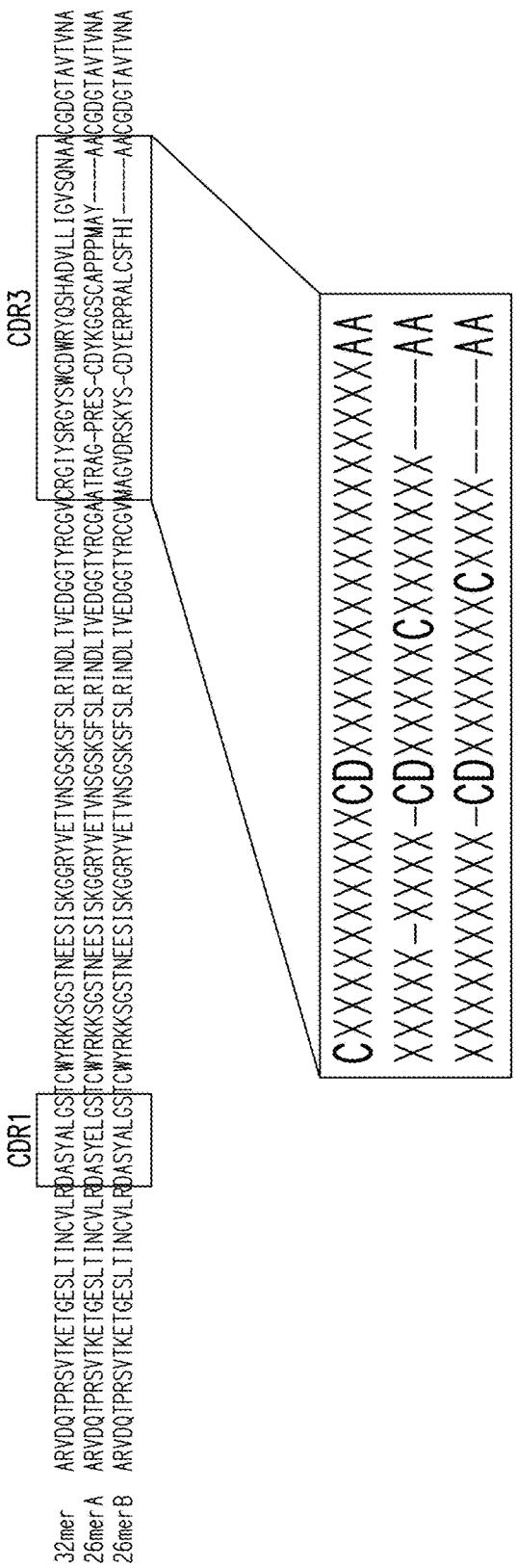

FIG. 12 is a schematic showing the randomization strategy used on the CDR3 loops of three Type 1 VNARs harbouring long CDR3s (Example 6) and discloses SEQ ID NOS 473-475, 59, 476 and 61, respectively, in order of appearance.

FIG. 13A-13C show_sequences of clones (SEQ ID NOS 477-545, respectively, in order of appearance and by left most column) randomly selected in the final OSX-4 library, sorted by CDR3 length. Clones highlighted in grey express a potentially unstable Type 1 VNAR (Example 7).

Figure 14:
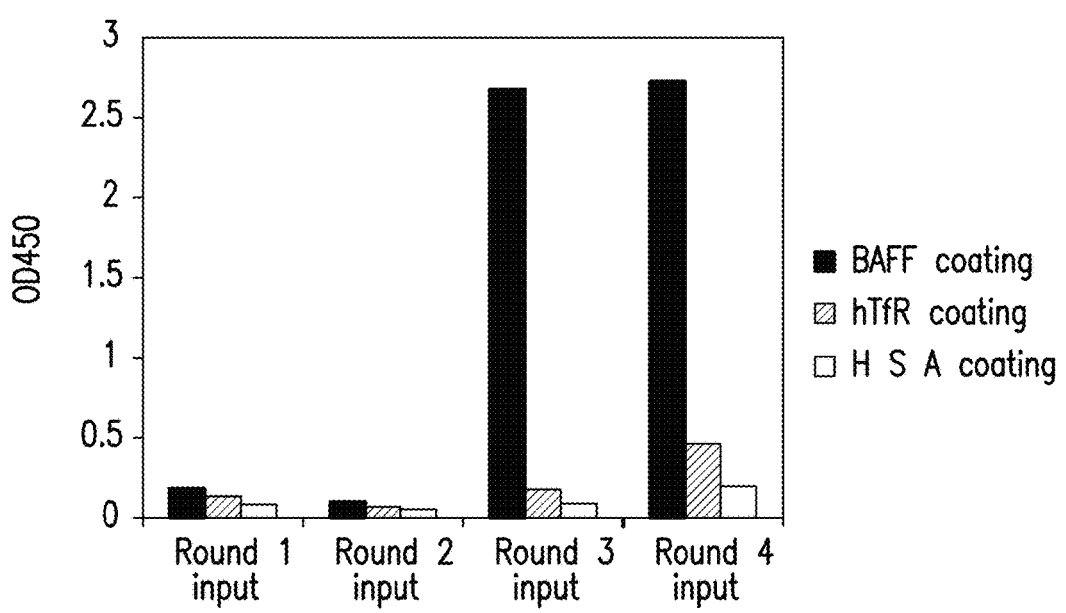

FIG. 14 shows results from polyclonal phage ELISA on BAFF selection outputs. Phage ($1 \times 10^{12}$) from each round's input were incubated in microwells coated with either BAFF, hTfR, or HSA. After washing, the bound phage were detected with a specific anti-M13 antibody (Example 8).

Figure 15:
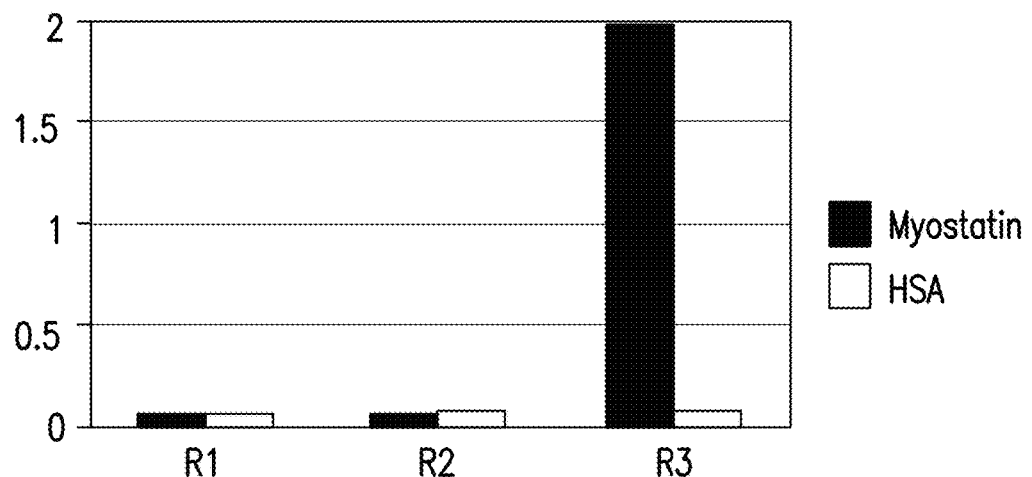

FIG. 15 shows enrichment of myostatin binders after successive rounds of panning. Phage populations after each round of panning on myostatin-coated plates were tested for binding to myostatin or HSA (negative control) by polyclonal phage ELISA. A selective increase in phage binders to myostatin occurred after three rounds of panning (Example 8).

Figure 16:
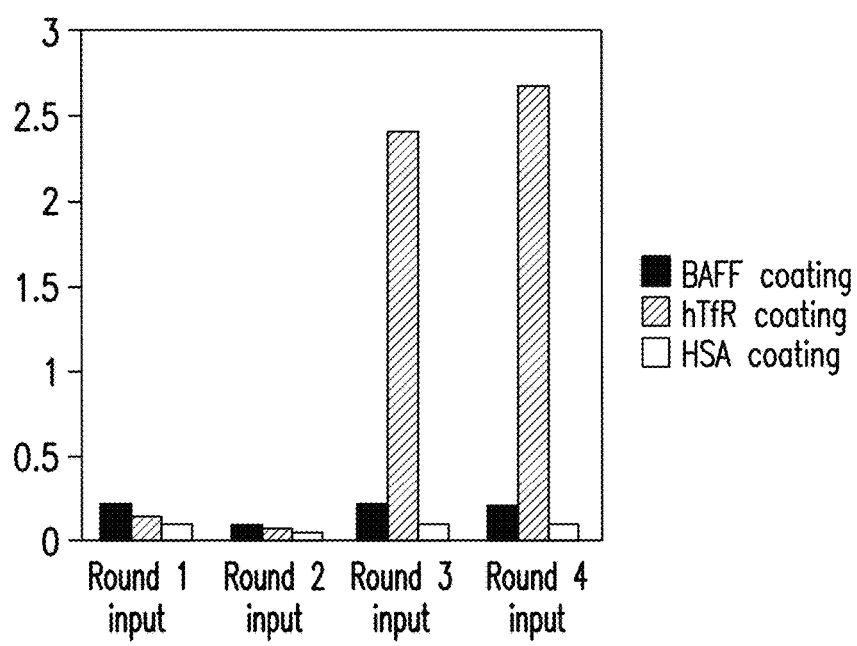

FIG. 16 shows the enrichment of hTfR-1 binders after successive rounds of panning. A selective increase in phage binders to rhTfR-1 relative to the negative controls occurred after 3 rounds of panning (Example 8).

Figure 17:
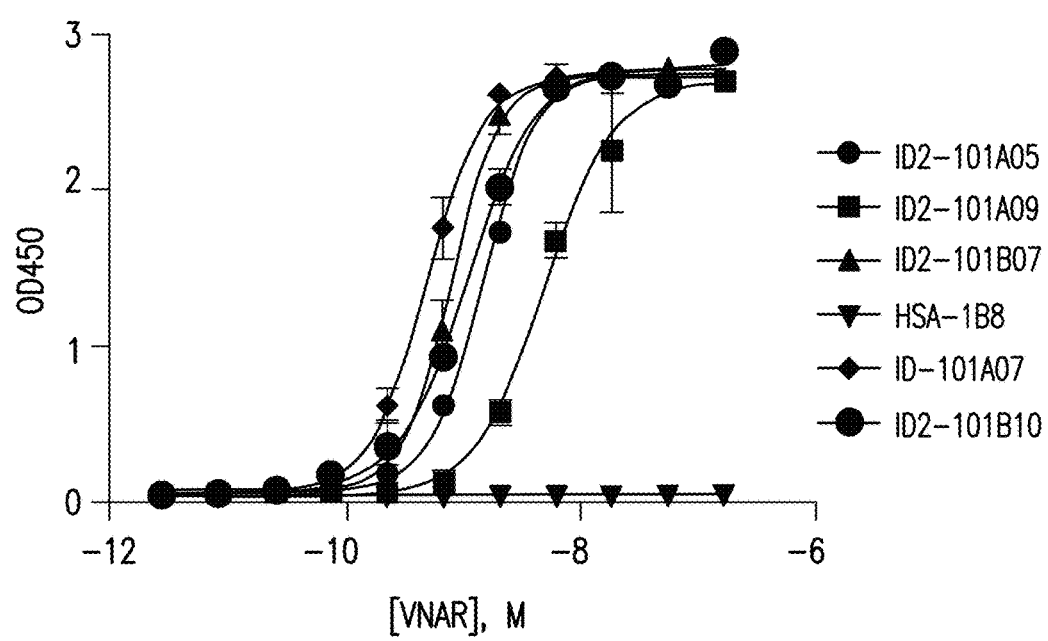

FIG. 17 shows EC50 binding curves of selected clones to immobilized BAFF. HSA-1B8 is a non-specific VNAR used as a negative control. The observed EC50s for five different VNARs ranged from 0.5 to 17 nM. (Example 8)

Figure 18:
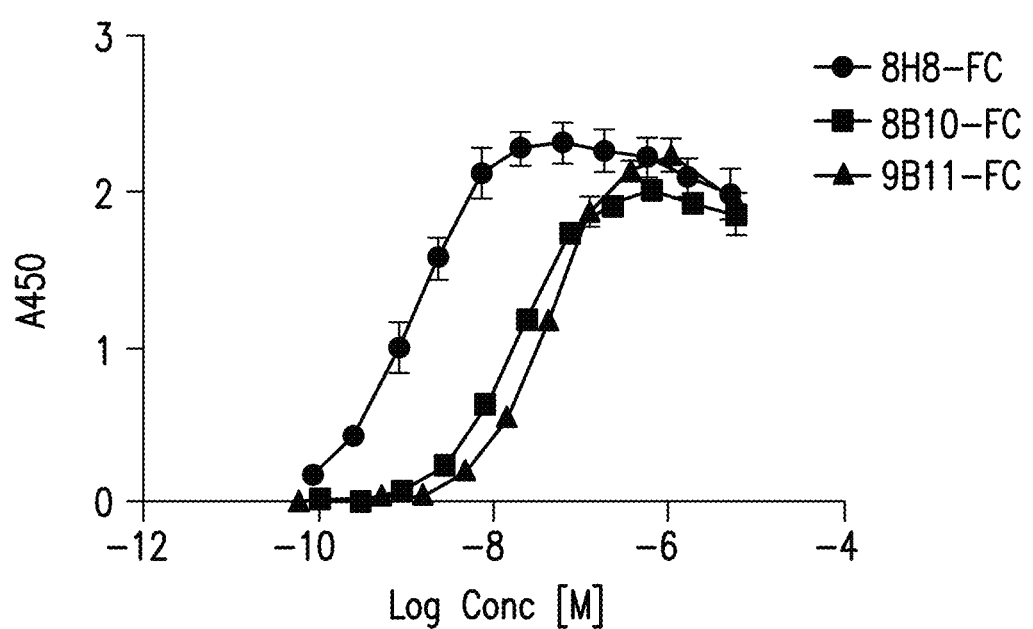

FIG. 18 shows EC50 binding curves of selected VNAR-Fcs to myostatin. Selected VNARs that bound to myostatin blocked its interaction with the ActRIIb receptor (not shown) as monomers were reformatted as Fc-fusion proteins and retested for binding activity (Example 8).

FIG. 19 shows EC50 binding curves of selected clones to immobilized TfR-1. Monomeric VNARs that internalized into either mouse or human cells when expressed as VNAR-Fc fusion proteins were selected for a range of binding potencies to (A) recombinant human or (B) recombinant mouse (Example 8).

Figure 20:
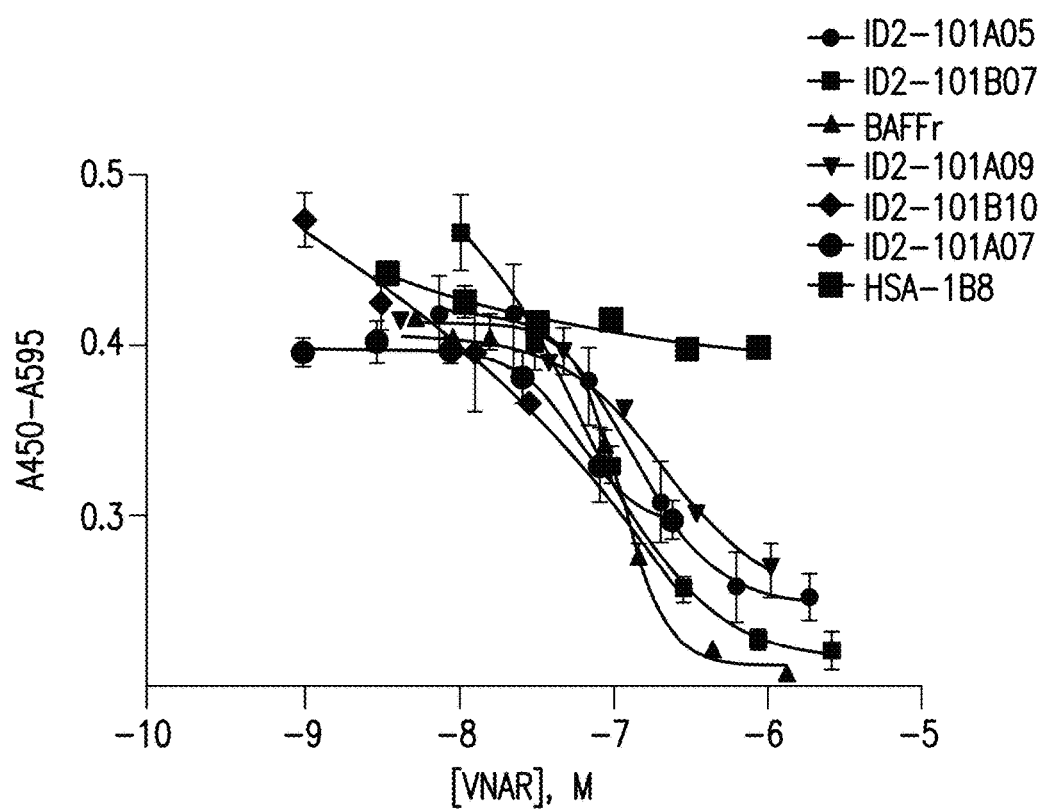

FIG. 20 shows inhibition of BAFF bioactivity in a mouse splenocyte assay. Mouse splenic B cells were exposed to BAFF in the presence or in the absence of five different VNARs. HSA-1B8 is a non-specific VNAR used as a negative control (Example 9).

FIG. 21 shows reversal of growth inhibition by myostatin in MPC11 cells. A: Two of the three VNAR-Fcs against myostatin were as active as the endogenous inhibitor follistatin at 250 nM. B: At 50 nM, 8H8-Fc was more efficacious than follistatin and growth restored to control levels (Example 10).

Figure 22A:
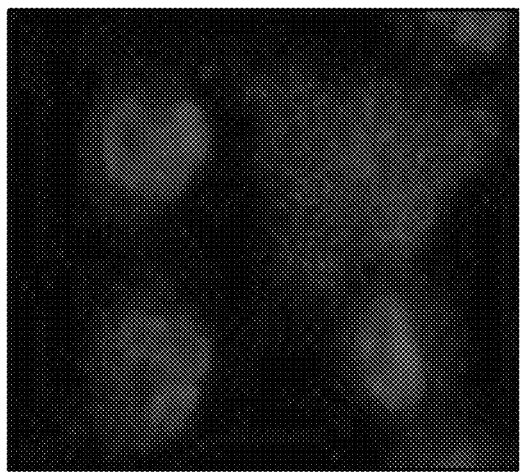
Figure 22B:
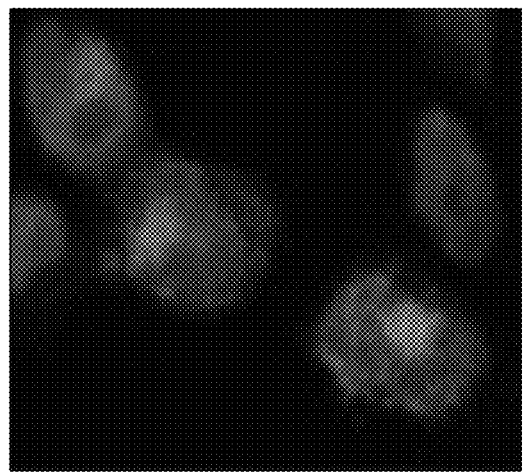

FIG. 22 shows the results of immunofluorescent screening for cell binding and internalization of human TfR-1. CHO cells expressing recombinant human TfR-1 were incubated prior to fixation with VNAR monomers from clone 101G4 at either 4° C. (A) showing surface staining or at 37° C. (B) showing intracellular staining (Example 11).

DETAILED DESCRIPTION OF THE INVENTION

In order that the present invention may be more readily understood, certain terms are defined below. Additional definitions may be found within the detailed description of the invention.

Throughout this specification, the word "comprise" or variations such as "comprises" or "comprising" will be understood to imply the inclusion of a stated integer (or components) or group of integers (or components), but not the exclusion of any other integer (or components) or group of integers (or components).

The singular forms "a," "an," and "the" include the plurals unless the context clearly dictates otherwise.

The term "plurality" as used herein refers to the number of members of a collection, which minimum is at least 10, 20, 30, 50, 75, 100, 1000 or more, and which minimum or maximum number may not be readily ascertainable but which may be indicated by type of collection or the context of its use. For example, a phage display library contains a plurality of phage equal to its titer (which may be the same or different), and by extension encodes a plurality of polypeptides.

The term "including" is used to mean "including but not limited to." "Including" and "including but not limited to" are used interchangeably.

The terms "patient," "subject," and "individual" may be used interchangeably and refer to either a human or a non-human animal. These terms include mammals such as humans, primates, livestock animals (e.g., bovines, porcines), companion animals (e.g., canines, felines) and rodents (e.g., mice and rats).

As used herein, "treating" or "treatment" and grammatical variants thereof refer to an approach for obtaining beneficial or desired clinical results. The term may refer to slowing the onset or rate of development of a condition, disorder or disease, reducing or alleviating symptoms associated with it, generating a complete or partial regression of the condition, or some combination of any of the above. For the purposes of this invention, beneficial or desired clinical results include, but are not limited to, reduction or alleviation of symptoms, diminishment of extent of disease, stabilization (i.e., not worsening) of state of disease, delay or slowing of disease progression, amelioration or palliation of the disease state, and remission (whether partial or total), whether detectable or undetectable. "Treatment" can also mean prolonging survival relative to expected survival time if not receiving treatment. A subject (e.g., a human) in need of treatment may thus be a subject already afflicted with the disease or disorder in question. The term "treatment" includes inhibition or reduction of an increase in severity of a pathological state or symptoms relative to the absence of treatment, and is not necessarily meant to imply complete cessation of the relevant disease, disorder or condition.

The term "heterologous" is used herein to refer to a configuration or association between two or more molecular elements derived from different sources or an association that otherwise does not occur in nature, e.g., a hybrid or fusion between polypeptide sequences from two different genes, of domains from different antibodies or from antibodies from different species, expression of a gene from one species in a host cell of another species, and the like.

As used herein, the terms "preventing" and grammatical variants thereof refer to an approach for preventing the development of, or altering the pathology of, a condition, disease or disorder. Accordingly, "prevention" may refer to prophylactic or preventive measures. For the purposes of this invention, beneficial or desired clinical results include, but are not limited to, prevention or slowing of symptoms, progression or development of a disease, whether detectable or undetectable. A subject (e.g., a human) in need of prevention may thus be a subject not yet afflicted with the disease or disorder in question. The term "prevention" includes slowing the onset of disease relative to the absence of treatment, and is not necessarily meant to imply permanent prevention of the relevant disease, disorder or condition. Thus "preventing" or "prevention" of a condition may in certain contexts refer to reducing the risk of developing the condition, or preventing or delaying the development of symptoms associated with the condition.

As used herein, an "effective amount," "therapeutically effective amount" or "effective dose" is an amount of a composition (e.g., a therapeutic composition or agent) that produces at least one desired therapeutic effect in a subject, such as preventing or treating a target condition or beneficially alleviating a symptom associated with the condition.

A. VNAR Semi-Synthetic Library Construction and Screening

1. Rational Design of a Type 2 Semi-Synthetic VNAR Library (OsX-3)

a. Bioinformatic Analysis of a Nurse Shark VNAR Type 2 Sequence Collection

In order to generate a sequence database from which information could be extracted to build a semi-synthetic nurse shark VNAR library, blood samples from two adult nurse sharks were collected and VNAR cDNA was amplified from the Peripheral Blood Leukocytes (PBL). Randomly-selected clones were sequenced and a total of 188 Type 2 VNAR sequences, containing a single cysteine residue in their CDR3, were collected. The amino acid sequences of these 188 VNARs were aligned in order to analyse the sequence conservation and other characteristics in both the framework and CDR3 regions (FIG. 1) (see also Example 1 and FIGS. 2-4).

Figure 2:
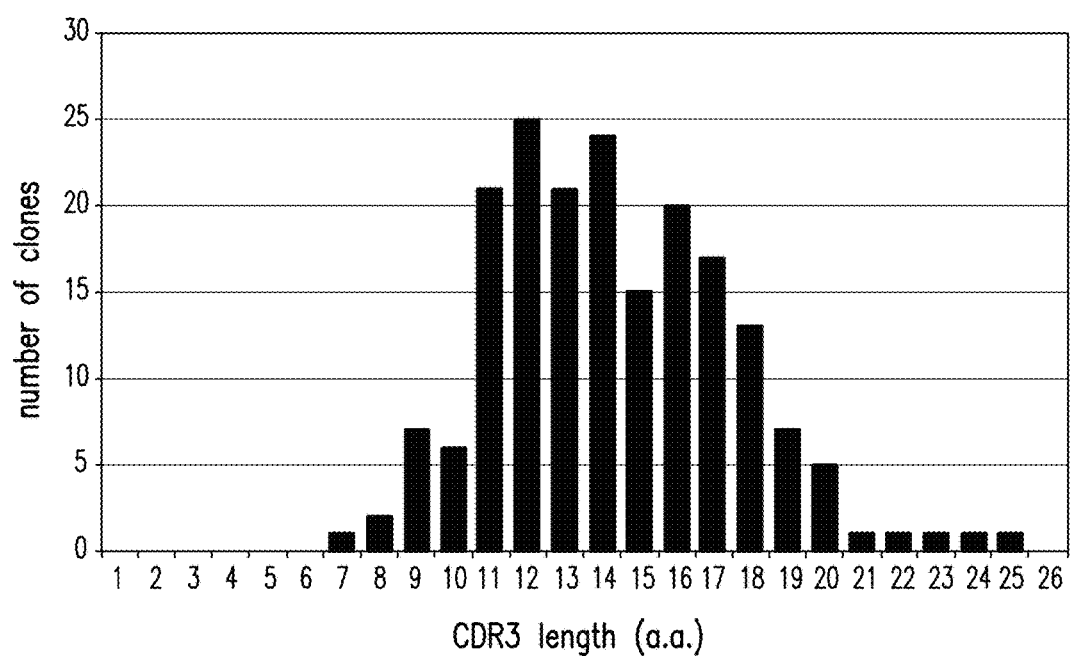
FIG. 2 shows the CDR3 size repartition of 188 Type 2 nurse shark VNARs plotted as number of clones as a function of CDR3 amino acid residue length (a.a.).

The sequence information collected and analysed included:

(1) The length of the CDR3s: It was observed that more than 80% of the naturally occurring Type 2 CDR3s have a length ranging from 11 to 18 amino acids (FIG. 2). These 8 different lengths were therefore chosen to build the semi-synthetic library.

(2) The position of the single cysteine in the CDR3: The amino acid composition at each position of the CDR3 was analysed and the preferred position of the single cysteine determined in the 8 selected CDR3 lengths (FIG. 4). This information was incorporated in the library design by either fixing a single cysteine residue in the CDR3 (using a TGC codon), or by using a "loose" cysteine approach by which the preferred cysteine position, as well as the two immediately adjacent residues, were mutated to a DRY degenerate codon (⅙ chance to form a cysteine).

Figure 1A:
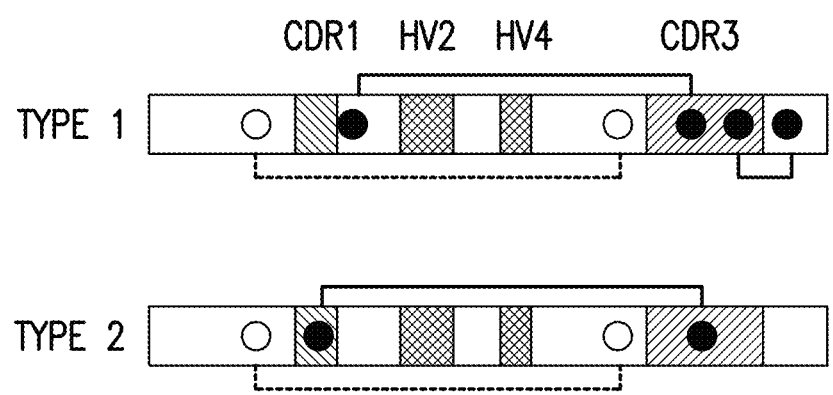
FIG. 1A is a schematic of VNAR subtypes. Type 1 VNARs contain two cysteine residues in CDR3, which form disulphide bridges (solid lines) to non-canonical cysteine residues in FW2 and FW4 (in addition, Type 1 VNARs may also contain an even number of extra cysteines in CDR3, which form intraloop cysteine bridges). Type 2 VNARs contain one canonical cysteine bridge (dashed line) and a single extra non-canonical disulphide bond (solid line), which links CDR1 and CDR3. Canonical cysteines=open circles; non-canonical cysteines=filled circles; canonical cysteine bridge=dashed line; non-canonical cysteine bridge=solid line.
Figure 1B3:
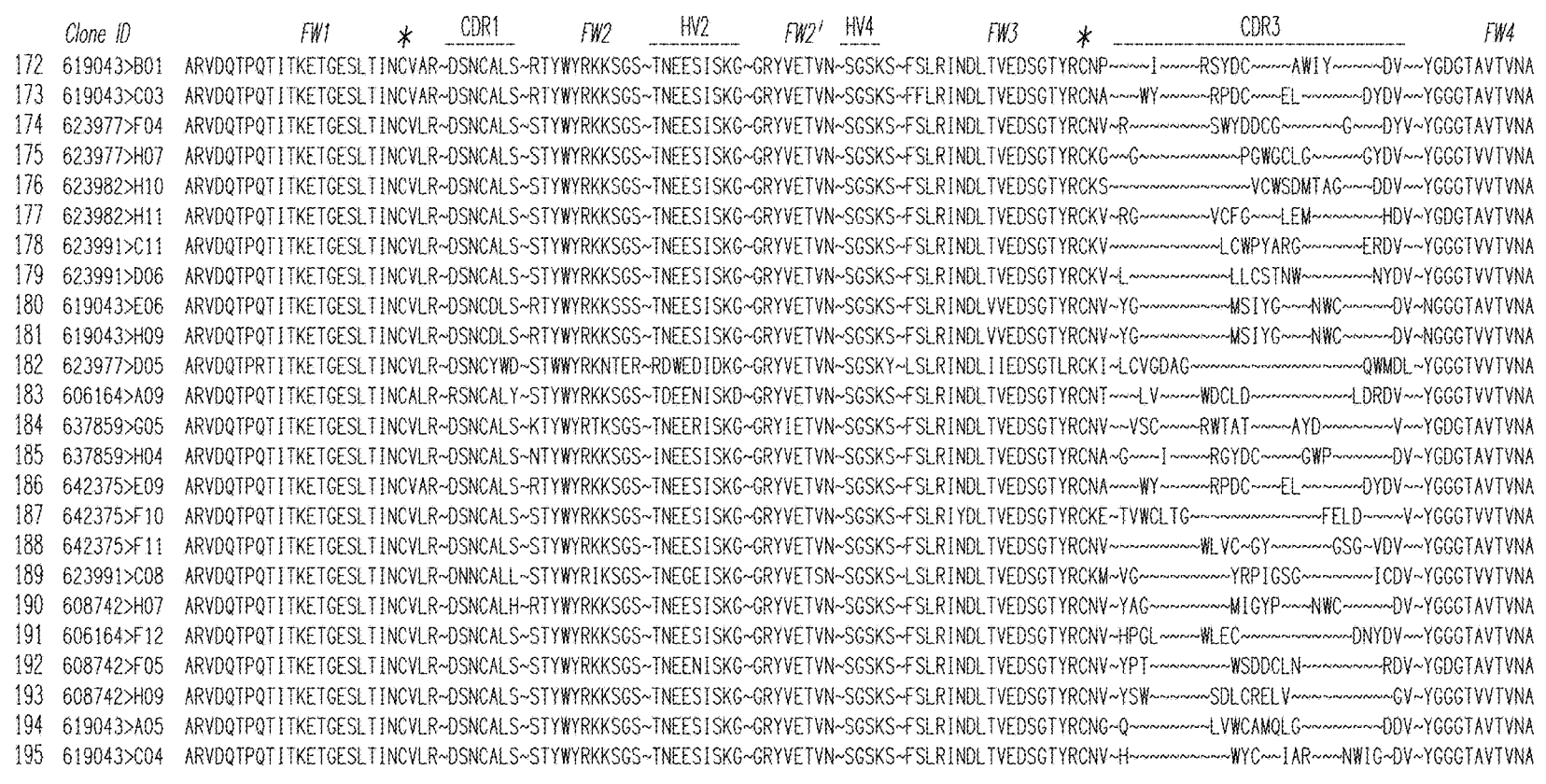

(3) The presence of fixed residues in CDR3: The same sequence analysis revealed that the amino acids DV were predominantly found at the last two positions of the CDR3 (FIG. 1B). This sequence information was incorporated into the library design by fixing these two amino acids residues.

(4) The most commonly found mutations in the framework regions: The analysis of the amino acid composition of the 188 VNAR backbones allowed identification of the most frequently found amino acid substitutions at every position of the framework regions (Table 1). The most frequent mutations were then introduced in the library design using a mixture of ten selected framework templates accumulating a number of frequently found mutations in the PCR reaction (FIG. 6; Table 2).

(5) The sequence conservation on the edges of the CDR3: The same framework analysis allowed identification of specific sequence variations on the edges of the CDR3 region (FIG. 3). It was observed that shorter CDR3s (less than 16 amino acids) were usually preceded by the CNV sequence, while longer CDR3s (more than 16 amino acids) were usually preceded by the CKV sequence (FIG. 7). This sequence variation was therefore incorporated in the library design by fixing amino acids at these positions. Three main sequence permutations were also observed in C-terminus of the CDR3. These sequence variations were also included in the library design by synthesising three sets of oligonucleotides incorporating each amino acid permutation (Table 2).

b. Design of a VNAR Type 2 Semi-Synthetic Library (OsX-3)

The information collected from analyses of the Type 2 database in Example 1 was included in a new semi-synthetic design of a VNAR Type 2 library incorporating amino acid sequence variation in both the CDR3 and the framework regions (Example 2).

Figure 5:
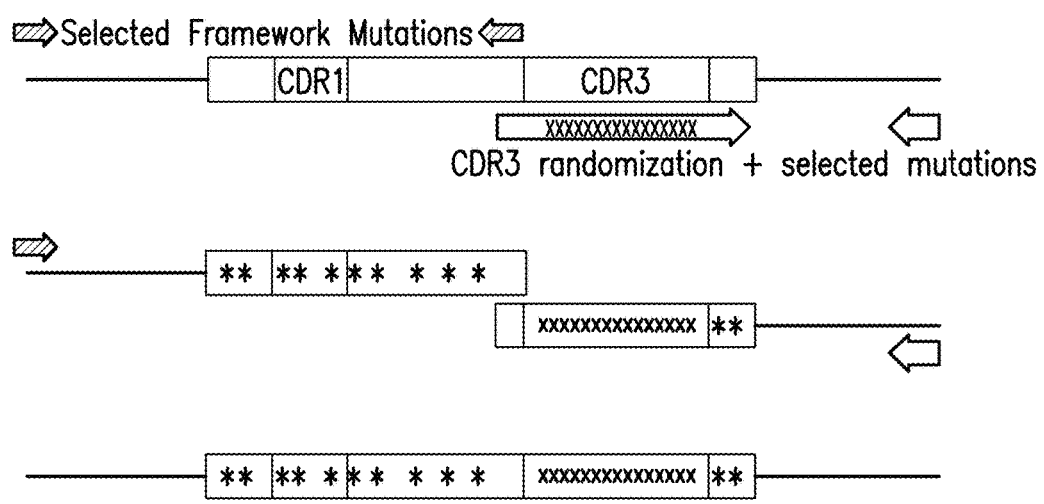
FIG. 5 is a schematic of the overlap PCR principle for OsX-3 library generation, in which sequence variability is introduced in both the VNAR frameworks and the CDR3. A first fragment (left arm) containing various framework mutations (asterisks) is amplified and hybridized with a second fragment (right arm), which incorporates both CDR3 randomization (Xs) and sequence variation on the CDR3 edges (asterisks). Amplification of the resulting hybrid molecule gives rise to a library of molecules incorporating numerous framework mutations as well as a randomized CDR3 (Example 2).

A Type 2 nurse shark VNAR semi-synthetic library was constructed by a rationale design based on sequence analysis of 188 Type 2 VNAR sequences containing a single cysteine in their CDR3 region (see M. Diaz, et al., *Immunogenetics* 54 (2002) pp. 501-512). The VNAR semi-synthetic library was generated by overlap PCR incorporating all of the above information to incorporate both randomization of the CDR3 by NNK codons, fixed and loose cysteine residues by use of TGC and DRY codons, and sequence variability on both edges of the CDR (Example 2; FIGS. 5-7).

c. Characterization of a VNAR Type 2 Semi-Synthetic Library (OsX-3)

Figure 8A:
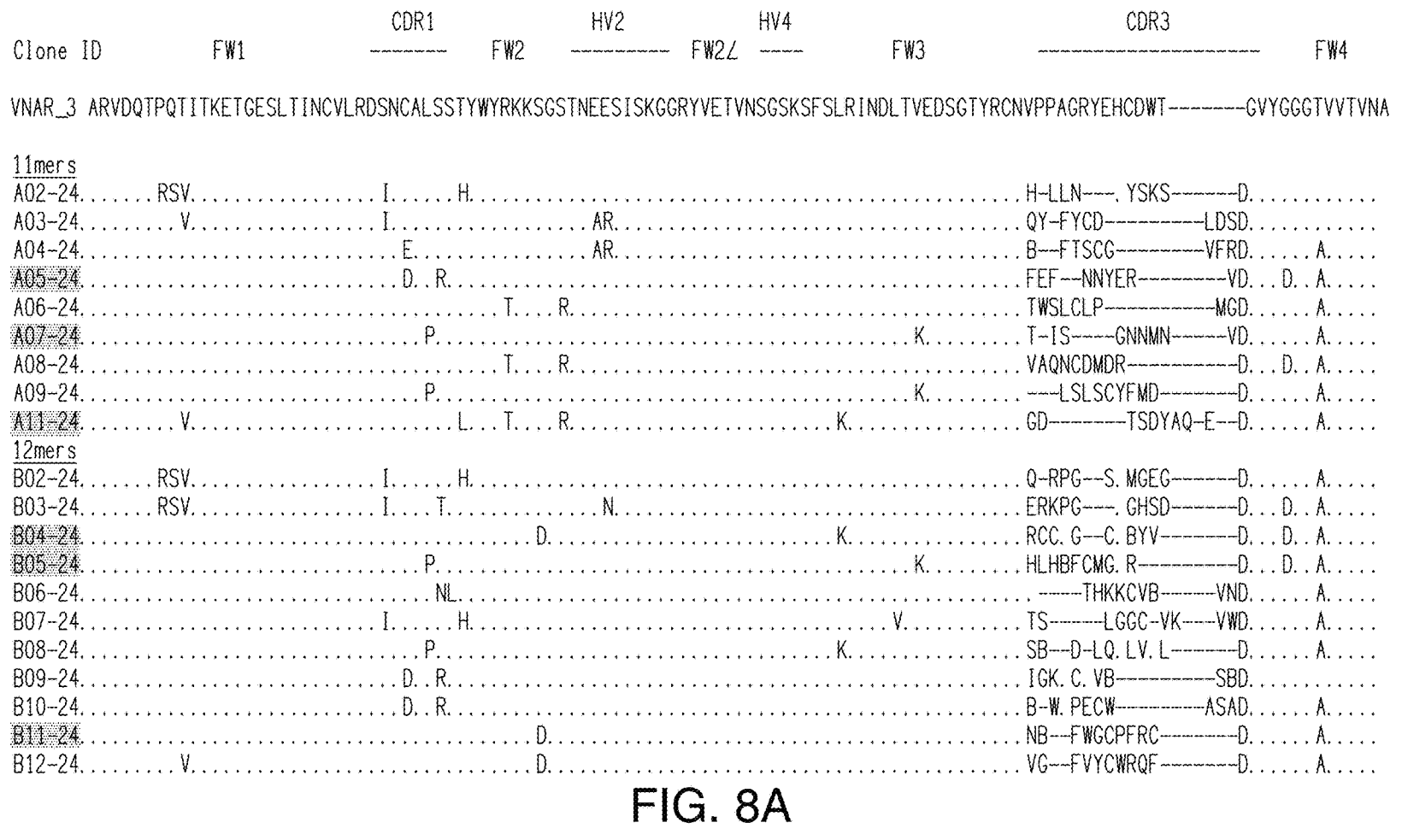
Figure 8C:
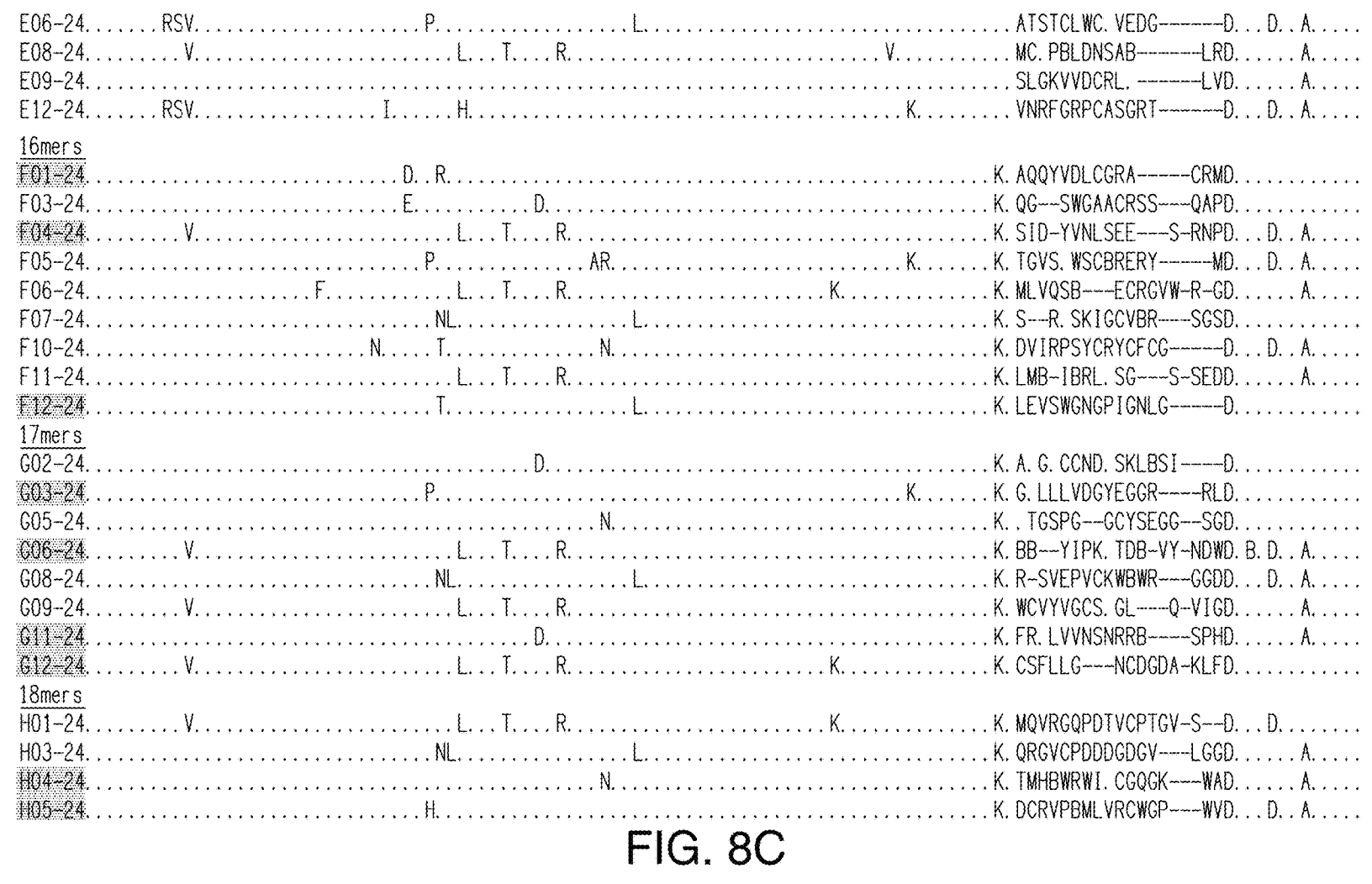
Figure 8D:
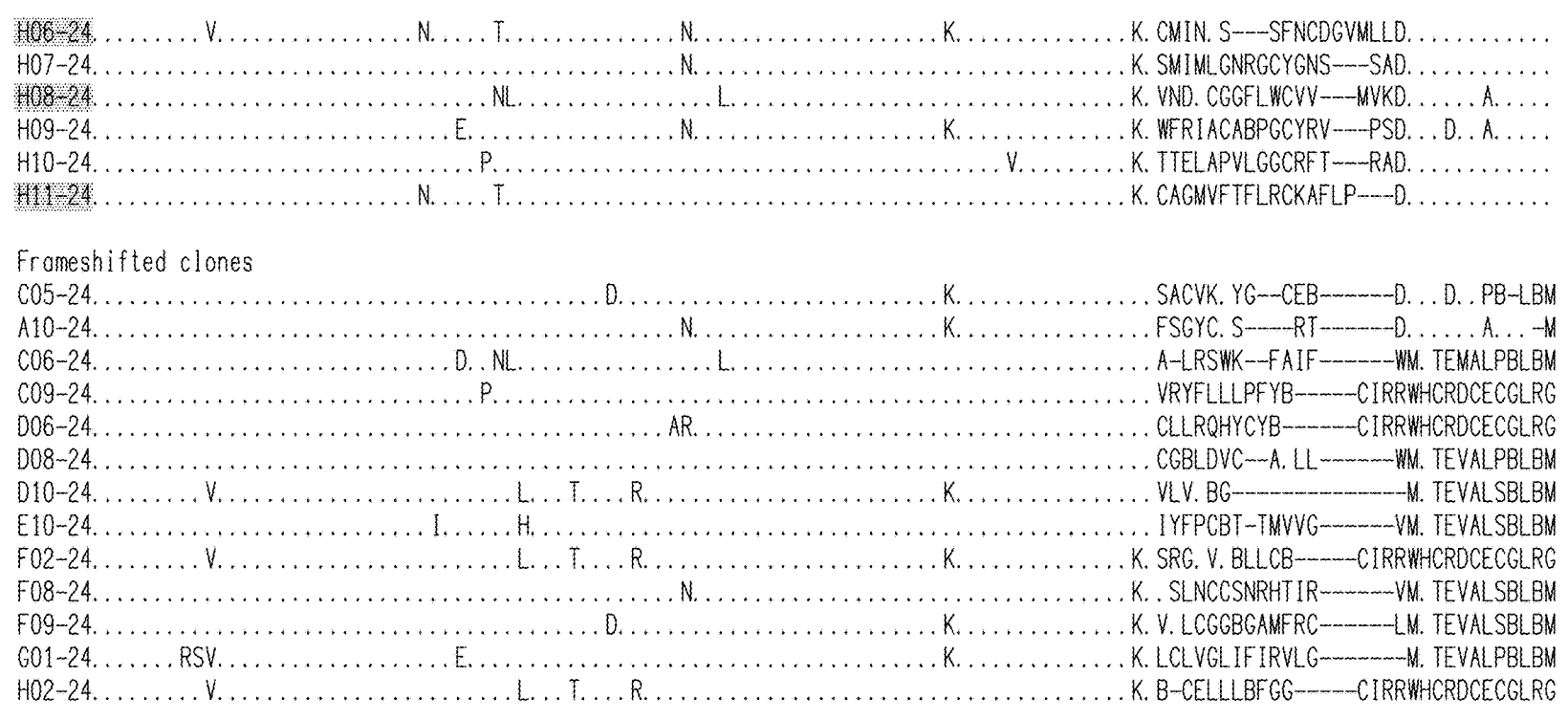

The molecular quality of the OsX-3 library was assessed by sequencing the VNAR inserts of 96 randomly picked clones (Example 3). Alignment of all sequenced molecules revealed that the semi-synthetic Type 2 VNARs display the expected sequence variability in both the framework and in the CDR3 regions (FIG. 8). The OsX-3 library contains approximately $1.6 \times 10^{10}$ unique sequences.

As described in Example 3, the percentage of a particular amino acid residue at each position of the VNAR backbone was determined in 3 pools of sequences. The naïve pool (composed of 188 sequences), the final semi-synthetic library (composed of 72 sequences), and the theoretical library (composed of the 10 templates in equal amounts (n=10)) (see Example 3; Table 2). From these data, a consensus sequence for a VNAR Type 2 backbone was derived, which may be expressed as follows (SEQ ID NO: 9):

$$\text{ARVDQTPX}_1\text{X}_2\text{X}_3^{(10)}\text{TKETGESLTI}^{(20)}$$
$$\text{NCVLRDX}_4\text{X}_5\text{CX}_6^{(30)}\text{LX}_7\text{X}_8\text{X}_9\text{X}_{10}\text{WYR X}_{11}$$
$$\text{K}^{(40)}\text{SX}_{12}\text{SX}_{13}\text{NEX}_{14}\text{X}_{15}\text{IS}^{(50)}$$
$$\text{X}_{16}\text{GGRYVETVN}^{(60)}\text{SGSKSFSLX}_{17}\text{I}^{(70)}$$

NDLX$_{18}$VX$_{19}$DSG T$^{(80)}$YRCX$_{20}$V$^{(85)}$-[ . . . CDR3]-YGX$_{21}$GTX$_{22}$VTVNA wherein amino acid compositions at each position X are:

$X_1$=Q and R, with R being present in more than 4.4% of the polypeptides; OR $X_2$=T and S, with S being present in more than 5.4% of the polypeptides; OR $X_3$=I and V, with V being present in more than 4.4% of the polypeptides;

$X_4$=S and N $X_5$=N and I, with I being present in more than 3.2% of the polypeptides;

$X_6$=A, D and E, with D being present in more than 3.2% of the polypeptides and E being present in more than 2.2% of the polypeptides;

$X_7$=S and P, with P being present in more than 2.1% of the polypeptides;

$X_8$=S, R, T and N, with T being present in more than 1% of the polypeptides, and N being present in more than 5.3% of the polypeptides;

$X_9$=T and L, with L being present in more than 1.1% of the polypeptides;

$X_{10}$=Y, H and L, with H being present in more than 2.1% of the polypeptides and L being present in more than 2.1% of the polypeptides;

$X_{11}$=K and T, with T being present in more than 4.4% of the polypeptides;

$X_{12}$=G and D, with D being present in more than 4.4% of the polypeptides;

$X_{13}$=T and R, with R being present in more than 5.3% of the polypeptides;

$X_{14}$=E and A, with A being present in more than 1.1% of the polypeptides;

$X_{15}$=S, N and R, with R being present in more than 3.2% of the polypeptides;

$X_{16}$=K and L, with L being present in more than 3.2% of the polypeptides;

$X_{17}$=R and K, with K being present in more than 3.2% of the polypeptides;

$X_{18}$=T and V, with V being present in more than 3.2% of the polypeptides;

$X_{19}$=E and K, with K being present in more than 1.1% of the polypeptides;

$X_{20}$=N and K;

$X_{21}$=G and D; and $X_{22}$=V and A;

and wherein the [ . . . CDR3 . . . ] region of each polypeptide comprises 7 to 25 amino acid residues partially randomized compared to germline Type 2 2 VNAR sequences which mediate specific binding of the polypeptide to a target molecule of interest.

The CDR3 regions in native nurse shark VNAR domains have high sequence diversity created by V-D-J immunoglobulin gene rearrangements. In contrast, the CDR3 regions of the libraries of the present invention harbour a partially randomized CDR3 region in which certain amino acid residues within the VNAR variable regions have been designed to be fully randomized compared to native VNAR antibody compositions.

Examples of Type 2 VNAR CDR3 regions for use in the present invention include but are not limited to the following amino acid sequences which begin with the last two amino acids of the FW3 region (where N or K, as the case may be, is $X_{20}$ in sequence shown in ¶66 above), have the indicated CDR3 region (ranging from 11 to 17 amino acids) and provide for the first six amino acids of the FW4 region (beginning with YGG or YGD) as shown:

(i)
(11-mer)

NV[X]$_4$C[X]$_4$DVYGGGTV, (SEQ ID NO: 10)

NV[X]$_4$C[X]$_4$DVYGGGTA, (SEQ ID NO: 11)

NV[X]$_4$C[X]$_4$DVYGDGTA, (SEQ ID NO: 12)

NV[X]$_3$[Z]$_3$[X]$_3$DVYGGGTV, (SEQ ID NO: 13)

NV[X]$_3$[Z]$_3$[X]$_3$DVYGGGTA, (SEQ ID NO: 14)

NV[X]$_3$[Z]$_3$[X]$_3$DVYGDGTA, (SEQ ID NO: 15)

(ii)
(12-mer)

NV[X]$_5$C[X]$_4$DVYGGGTV, (SEQ ID NO: 16)

NV[X]$_5$C[X]$_4$DVYGGGTA, (SEQ ID NO: 17)

NV[X]$_5$C[X]$_4$DVYGDGTA, (SEQ ID NO: 18)

NV[X]$_3$[Z]$_3$[X]$_4$DVYGGGTV, (SEQ ID NO: 19)

NV[X]$_3$[Z]$_3$[X]$_4$DVYGGGTA, (SEQ ID NO: 20)

NV[X]$_3$[Z]$_3$[X]$_4$DVYGDGTA, (SEQ ID NO: 21)

NV[X]$_7$C[X]$_3$DVYGGGTV, (SEQ ID NO: 22)

(iii)
(13-mer)

NV[X]$_7$C[X]$_3$DVYGGGTA, (SEQ ID NO: 23)

NV[X]$_7$C[X]$_3$DVYGDGTA, (SEQ ID NO: 24)

NV[X]$_5$[Z]$_3$[X]$_3$DVYGGGTV, (SEQ ID NO: 25)

NV[X]$_5$[Z]$_3$[X]$_3$DVYGGGTA, (SEQ ID NO: 26)

NV[X]$_5$[Z]$_3$[X]$_3$DVYGDGTA, (SEQ ID NO: 27)

(iv)
(14-mer)

NV[X]$_7$C[X]$_4$DVYGGGTV, (SEQ ID NO: 28)

NV[X]$_7$C[X]$_4$DVYGGGTA, (SEQ ID NO: 29)

NV[X]$_7$C[X]$_4$DVYGDGTA, (SEQ ID NO: 30)

NV[X]$_6$[Z]$_3$[X]$_3$DVYGGGTV, (SEQ ID NO: 31)

NV[X]$_6$[Z]$_3$[X]$_3$DVYGGGTA, (SEQ ID NO: 32)

-continued

NV[X]$_6$[Z]$_3$[X]$_3$DVYGDGTA,   (SEQ ID NO: 33)

(v)
(15-mer)

NV[X]$_7$C[X]$_5$DVYGGGTV,   (SEQ ID NO: 34)

NV[X]$_7$C[X]$_5$DVYGGGTA,   (SEQ ID NO: 35)

NV[X]$_7$C[X]$_5$DVYGDGTA,   (SEQ ID NO: 36)

NV[X]$_6$[Z]$_3$[X]$_4$DVYGGGTV,   (SEQ ID NO: 37)

NV[X]$_6$[Z]$_3$[X]$_4$DVYGGGTA,   (SEQ ID NO: 38)

NV[X]$_6$[Z]$_3$[X]$_4$DVYGDGTA,   (SEQ ID NO: 39)

(vi)
(16-mer)

KV[X]$_7$C[X]$_6$DVYGGGTV,   (SEQ ID NO: 40)

KV[X]$_7$C[X]$_6$DVYGGGTA,   (SEQ ID NO: 41)

KV[X]$_7$C[X]$_6$DVYGDGTA,   (SEQ ID NO: 42)

KV[X]$_3$ZXZXZ[X]$_6$DVYGGGTV,   (SEQ ID NO: 43)

KV[X]$_3$ZXZXZ[X]$_6$DVYGGGTA,   (SEQ ID NO: 44)

KV[X]$_3$ZXZXZ[X]$_6$DVYGDGTA,   (SEQ ID NO: 45)

KV[X]$_6$C[X]$_8$DVYGGGTV,   (SEQ ID NO: 46)

(vii)
(17-mer)

KV[X]$_6$C[X]$_8$DVYGGGTA,   (SEQ ID NO: 47)

KV[X]$_6$C[X]$_8$DVYGDGTA,   (SEQ ID NO: 48)

KV[X]$_6$[Z]$_3$[X]$_6$DVYGGGTV,   (SEQ ID NO: 49)

KV[X]$_6$[Z]$_3$[X]$_6$DVYGGGTA,   (SEQ ID NO: 50)

KV[X]$_6$[Z]$_3$[X]$_6$DVYGDGTA,   (SEQ ID NO: 51)

(viii)
(18-mer)

KV[X]$_{10}$C[X]$_5$DVYGGGTV,   (SEQ ID NO: 52)

KV[X]$_{10}$C[X]$_5$DVYGGGTA,   (SEQ ID NO: 53)

KV[X]$_{10}$C[X]$_5$DVYGDGTA,   (SEQ ID NO: 54)

KV[X]$_8$[Z]$_3$[X]$_5$DVYGGGTV,   (SEQ ID NO: 55)

KV[X]$_8$[Z]$_3$[X]$_5$DVYGGGTA,   (SEQ ID NO: 56)

or

KV[X]$_8$[Z]$_3$[X]$_5$DVYGDGTA,   (SEQ ID NO: 57)

wherein each X is independently any amino acid and each Z is N, S, D, G, Y or C, provided that at least one Z is C.

One embodiment of the invention includes a nucleic acid-containing library, preferably a phage display library, whose members each comprise a nucleic acid encoding a semi-synthetic Type 2 VNAR polypeptide of the formula, from N-terminus to C-terminus,

FW1-CDR1-FW2-HV2-FW2'-HV4-FW3-CDR3*-FW4* wherein (a) FW1-CDR1-FW2-HV2-FW2'-HV4-FW3 has an amino acid sequence of any one of molecules VNAR_1 to VNAR-10 shown in FIG. 6A; and (b) CDR3* has an amino acid sequence of any one of (ix)
(11-mer)

NV[X]$_4$C[X]$_4$DVYGGGTV,   (SEQ ID NO: 10)

NV[X]$_4$C[X]$_4$DVYGGGTA,   (SEQ ID NO: 11)

NV[X]$_4$C[X]$_4$DVYGDGTA,   (SEQ ID NO: 12)

NV[X]$_3$[Z]$_3$[X]$_3$DVYGGGTV,   (SEQ ID NO: 13)

NV[X]$_3$[Z]$_3$[X]$_3$DVYGGGTA,   (SEQ ID NO: 14)

NV[X]$_3$[Z]$_3$[X]$_3$DVYGDGTA,   (SEQ ID NO: 15)

(x)
(12-mer)

NV[X]$_5$C[X]$_4$DVYGGGTV,   (SEQ ID NO: 16)

NV[X]$_5$C[X]$_4$DVYGGGTA,   (SEQ ID NO: 17)

NV[X]$_5$C[X]$_4$DVYGDGTA,   (SEQ ID NO: 18)

NV[X]$_3$[Z]$_3$[X]$_4$DVYGGGTV,   (SEQ ID NO: 19)

NV[X]$_3$[Z]$_3$[X]$_4$DVYGGGTA,   (SEQ ID NO: 20)

NV[X]$_3$[Z]$_3$[X]$_4$DVYGDGTA,   (SEQ ID NO: 21)

NV[X]$_7$C[X]$_3$DVYGGGTV,   (SEQ ID NO: 22)

(xi)
(13-mer)

NV[X]$_7$C[X]$_3$DVYGGGTA,   (SEQ ID NO: 23)

NV[X]$_7$C[X]$_3$DVYGDGTA,   (SEQ ID NO: 24)

(xii)
(14-mer)

NV[X]₅[Z]₃[X]₃DVYGGGTV, (SEQ ID NO: 25)

NV[X]₅[Z]₃[X]₃DVYGGGTA, (SEQ ID NO: 26)

NV[X]₅[Z]₃[X]₃DVYGDGTA, (SEQ ID NO: 27)

NV[X]₇C[X]₄DVYGGGTV, (SEQ ID NO: 28)

NV[X]₇C[X]₄DVYGGGTA, (SEQ ID NO: 29)

NV[X]₇C[X]₄DVYGDGTA, (SEQ ID NO: 30)

NV[X]₆[Z]₃[X]₃DVYGGGTV, (SEQ ID NO: 31)

NV[X]₆[Z]₃[X]₃DVYGGGTA, (SEQ ID NO: 32)

NV[X]₆[Z]₃[X]₃DVYGDGTA, (SEQ ID NO: 33)

(xiii)
(15-mer)

NV[X]₇C[X]₅DVYGGGTV, (SEQ ID NO: 34)

NV[X]₇C[X]₅DVYGGGTA, (SEQ ID NO: 35)

NV[X]₇C[X]₅DVYGDGTA, (SEQ ID NO: 36)

NV[X]₆[Z]₃[X]₄DVYGGGTV, (SEQ ID NO: 37)

NV[X]₆[Z]₃[X]₄DVYGGGTA, (SEQ ID NO: 38)

NV[X]₆[Z]₃[X]₄DVYGDGTA, (SEQ ID NO: 39)

(xiv)
(16-mer)

KV[X]₇C[X]₆DVYGGGTV, (SEQ ID NO: 40)

KV[X]₇C[X]₆DVYGGGTA, (SEQ ID NO: 41)

KV[X]₇C[X]₆DVYGDGTA, (SEQ ID NO: 42)

KV[X]₃ZXZXZ[X]₆DVYGGGTV, (SEQ ID NO: 43)

KV[X]₃ZXZXZ[X]₆DVYGGGTA, (SEQ ID NO: 44)

KV[X]₃ZXZXZ[X]₆DVYGDGTA, (SEQ ID NO: 45)

KV[X]₆C[X]₈DVYGGGTV, (SEQ ID NO: 46)

(xv)
(17-mer)

KV[X]₆C[X]₈DVYGGGTA, (SEQ ID NO: 47)

KV[X]₆C[X]₈DVYGDGTA, (SEQ ID NO: 48)

KV[X]₆[Z]₃[X]₆DVYGGGTV, (SEQ ID NO: 49)

KV[X]₆[Z]₃[X]₆DVYGGGTA, (SEQ ID NO: 50)

KV[X]₆[Z]₃[X]₆DVYGDGTA, (SEQ ID NO: 51)

(xvi)
(18-mer)

KV[X]₁₀C[X]₅DVYGGGTV, (SEQ ID NO: 52)

KV[X]₁₀C[X]₅DVYGGGTA, (SEQ ID NO: 53)

KV[X]₁₀C[X]₅DVYGDGTA, (SEQ ID NO: 54)

KV[X]₈[Z]₃[X]₅DVYGGGTV, (SEQ ID NO: 55)

KV[X]₈[Z]₃[X]₅DVYGGGTA (SEQ ID NO: 56)

or

KV[X]₈[Z]₃[X]₅DVYGDGTA (SEQ ID NO: 57)

wherein each X is independently any amino acid and each Z is N, S, D, G, Y or C, provided that at least one Z is C; and (c) FW4* has an amino acid sequence VTVNA (SEQ ID NO: 58), and wherein CDR3* represents CDR3 where the two amino-terminal amino acids are from FW3 and the six carboxy-terminal amino acids are from FW4, and FW4* represents FW4 without those same six amino acids (and those six being the six amino-terminal amino acids of FW4).

The OsX-3 VNAR library inserts were used to construct a phage display library in order to test its physical complexity and to screen for binding moieties contained in the OsX-3 library capable of binding select molecular target molecules with high affinity and selectivity. To test its complexity, the OsX-3 library was used in two concurrent phage display selections on two different target proteins, namely, BAFF and human Transferrin receptor. VNARs binding specifically to these target proteins were isolated by selection and amplification of the library on immobilized human BAFF or hTfR recombinant proteins (Example 4; FIG. 9). Eighteen different specific clones were identified in the BAFF selection, nine of which were found more than once in the sequenced panel (Example 4; FIG. 10). In the hTfR selection, forty different specific clones were identified, twenty of which were found more than once in the sequenced panel. The sequence analyses of selected clones and variants suggest that the functional diversity of the OsX-3 library is very high.

2. Rational Design of a Type 1 Semi-Synthetic VNAR Library (OsX-4)

Type 1 VNAR sequences are known to have longer CDR3 regions than Type 2 VNAR sequences (Diaz et al. 2002, Barelle et al. 2009). In order to identify nurse shark Type 1 VNAR sequences, we used the sequence collection of VNARs from naïve libraries built from two different adult nurse sharks as described in Example 1. We extracted all Type 1 VNAR molecules from the database and characterized the CDR3s of three specific clones to generate information about sequence variability in Type 1 CDR3 regions (Example 5; FIG. 11). These Type 1 VNAR clones harboured unusually long CDR3 regions of 26 and 32 amino acids and had very few framework mutations.

To generate a semi-synthetic Type 1 VNAR library biased for long CDR3 regions, the CDR3 sequences of these 3 clones were randomized, keeping only the two cysteine residues unchanged in order to preserve the structural integrity of the molecule and without any further framework mutations, by overlap PCR as described in Example 6 (see also FIGS. 5 and 12).

The molecular quality of the OsX-4 library was assessed by sequencing the VNAR insert of randomly-picked clones as described in Example 7 (see also FIG. 13). The OsX4 library contains approximately $5.0 \times 10^9$ unique sequences.

One embodiment of the invention includes a nucleic acid-containing library, preferably a phage display library, whose members each comprise a nucleic acid encoding a semi-synthetic Type 1 VNAR polypeptide of the formula, from N-terminus to C-terminus,

FW1-CDR1-FW2-HV2-FW2'-HV4-FW3-CDR3-FW4 wherein
(a) FW1-CDR1-FW2-HV2-FW2'-HV4-FW3 has an amino acid sequence from any Type 1 VNAR;
(b) CDR3 has an amino acid sequence of any one of (i)
$C[X]_{10}CD[X]_{17}AA$; (SEQ ID NO: 59)

(ii)
$[X]_9CD[X]_5C[X]_7AA$; (SEQ ID NO: 60)
or (iii)
$[X]_{10}CD[X]_7C[X]_4AA$; (SEQ ID NO: 61)

wherein each X is independently any amino acid; and
(c) FW4 has an amino acid sequence from any Type 1 VNAR.

3. Phage Display Selection of Synthetic VNARs Having Particular Binding Properties Selection of BAFF-, myostatin- and hTfR-interacting VNARs, displayed as a fusion of the PIII protein on M13 bacteriophage, was performed as described in Example 8. VNARs capable of specifically and selectively binding to these exemplary molecular target molecules were isolated by four rounds of selection and amplification of a semi-synthetic phage display library on immobilized hBAFF, myostatin or hTfR-1 recombinant proteins. To select for clones with high affinity binding, the stringency of selection was increased at each round by decreasing hBAFF, myostatin or hTfR-1 concentrations and increasing the number of washing steps. The efficiency of the selection procedure was assessed by plotting the percentage of eluted phages after each selection round. The respective binding specificities of selected phage were confirmed by polyclonal phage ELISAs in which coatings with different molecular specificities were used (BAFF, hTfR, and HSA) (FIG. 14). A selective increase in phage binders to hBAFF relative to the negative controls occurred after 3 rounds of panning. Similar enrichments were seen for selection on myostatin (FIG. 15) and hTfR-1 (FIG. 16).

To test the ability of the selected BAFF binding clones to block the interaction between BAFF and its receptor, BAFF-R, a periplasmic fraction from each clone was pre-incubated with recombinant hBAFF before being exposed to a surface coated with BAFF-R. Ability to block the BAFF/BAFF-R interaction was then measured by specifically detecting the amount of BAFF bound to the plate by using a specific antibody, as described in Example 8. Similar tests may be performed on selected myostatin and hTfR-1 binding clones. As used herein, a blocking clone is one that is capable of inhibiting binding of the molecular target molecule to its receptor or cognate binding partner by at least 50%.

FIG. 17 shows EC50 binding curves of selected human BAFF-specific clones isolated from the OsX-3 library to bind to immobilized human BAFF. The observed EC50s for five different VNARs ranged from 0.5 to 17 nM (Example 8). Similarly, FIG. 18 shows EC50 binding curves of selected human myostatin-specific clones constructed as VNAR-Fcs (Example 8). Selected VNARs that bound to myostatin and which blocked its interaction with the ActRIIb receptor as monomers were reformatted as Fc-fusion proteins and retested for binding activity. EC50 values for 8H8-Fc, 8B10-Fc and 9B11-Fc were 1 nM, 38 nM and 17 nM, respectively. EC50 binding curves of selected clones enriched by binding to immobilized TfR-1 are shown in FIG. 19. Monomeric VNARs that internalized into either mouse or human cells when expressed as VNAR-Fc fusion proteins were selected for a range of binding potencies to recombinant human (A) or recombinant mouse (B) immobilized TfR-1 (Example 8).

$EC_{50}$ values may be used as a numerical measure of potency, such as for ability to bind with a given binding partner, e.g., a ligand or receptor. An $EC_{50}$ value is a measure of the concentration of a compound required to achieve half of that compound's maximal activity in a particular assay. An $IC_{50}$ value or inhibition constant is the concentration which inhibits binding of one agent to another agent by 50% and may also be used as a numerical measure of the ability of a synthetic VNAR binding moiety or molecular target antagonist compound to compete with a different binding agent having the same or overlapping binding activity, e.g., the ability of a BAFF-specific synthetic VNAR binding moiety or MTAC to compete with an anti-BAFF antibody for binding to human BAFF.

Binding affinities may be measured as a constant of binding affinity ($K_A$), or as a constant of dissociation from a bound complex ($K_D$). In some embodiments, compounds of the present invention, the $K_A$ or $K_D$ towards a molecular target is below 20 nM. In some embodiments of compounds of the present invention, the $K_A$ or $K_D$ towards a molecular target is below 10 nM. In further embodiments of compounds of the present invention, the $K_A$ or $K_D$ towards a molecular target is below 5 nM. In still further embodiments of compounds of the present invention, the $K_A$ or $K_D$ towards a molecular target is below 1 nM.

In certain embodiments, the binding activity of a synthetic VNAR binding moiety or a MTAC comprising such a binding moiety for a select molecular target is at least 3-fold higher than to a negative control, e.g., human serum albumin or to any other negative control protein. According to the present invention, selective binding may be quantified in terms of a binding ratio (a/b) of (a) binding to a target molecule of interest to (b) binding to a negative control or reference protein. In certain embodiments, a binding ratio indicative of selective binding to a target molecule (or a soluble domain thereof) is at least 3-fold, 5-fold, 10-fold, 15-fold, 20-fold, 25-fold, 30-fold, 40-fold, 50-fold, 75-fold, 100-fold, 250-fold, 500-fold, 750-fold, 1000-fold, 5000-fold or higher. Selective binding assays may be performed according to the examples disclosed herein or one of numerous molecular binding assays available in the art (e.g., in vitro or cell based binding assays).

Hence, the following methods are contemplated as methods of the invention which capture some or all of the foregoing methods. For example, one embodiment provides a method of identifying a polypeptide that binds selectively to a target molecule of interest which comprises (a) exposing a target molecule of interest to polypeptides of composition of the invention or to polypeptides produced by expression of a nucleic acid molecule or a library of the invention; and (b) separating those polypeptides that selectively bind from those that do not selectively bind the target molecule. In some instances, the target molecule of interest is expressed on the surface of a phage, bacterium or cell, or is attached to, tethered to or otherwise associated with a solid support. This method can be further used to identify high affinity binders from the polypeptide binders, wherein high affinity binders have an affinity of from about 0.1 nM to 250 nM, 1 nM to 250 nM, 10 nM to 250 nM, 50 nM to 250 nM, 100 nM to 250 nM, 0.1 nM to 100 nM, 1 nM to 100 nM, 10 nM to 100 nM, 50 nM to 100 nM, 0.1 nM to 50 nM, 1 nM to 50 nM, 5 nM to 50 nM, 10 nM to 50 nM, 0.1 nM to 25 nM, 1 nM to 25 nM, 5 nM to 25 nM, or 10 nM to 25 nM.

In another example, an embodiment of the invention provides a method of screening a library for a polypeptide that selectively binds with high affinity to a target molecule of interest, the library comprising a plurality of polypeptides of the invention which comprises (a) incubating a sample of a library with a concentration of a target molecule under conditions suitable for specific binding of the polypeptides to the molecule; (b) incubating a second sample of the library under the same conditions but without target molecule; (c) contacting each of the first and second sample with immobilized target molecule under conditions suitable for binding of the polypeptide to the immobilized target antigen; (d) detecting the polypeptide bound to immobilized target molecule for each sample; (e) determining the affinity of the polypeptide for the target molecule by calculating the ratio of the amounts of bound polypeptide from the first sample over the amount bound polypeptide from the second sample.

Yet a further example of an embodiment of the invention provides a method of identifying one or more polypeptides that selectively bind to a target molecule of interest which comprises (a) contacting a target molecule with a phage display library encoding the polypeptides of the composition of the invention or with a any other phage display library of the invention, (b) separating phage that selectively bind said target molecule from those that do not selectively bind said target molecule to produce an enriched phage library; (c) repeating steps (a) and (b) with the enriched phage library to produce a further enriched phage library; (d) repeating step (c) until the further enriched phage library is enriched from at least about 10- to about $10^6$-fold or more relative to the original phage library; and (e) plating the further enriched phage library, isolating and characterizing individual clones therefrom and thereby identifying one or more polypeptides that selectively bind to a target molecule of interest. The number of cycles needed to obtain a sufficiently further enriched phage library to readily isolate the desired, individual clones typically ranges from three to eight rounds of selection and more typically can be done with 3-4 rounds of selection. In this method, either the target molecule or the phage display library can be bound to or attached to a solid support to facilitate selective binding (and simplify wash conditions, which stringency can be varied in successive rounds (see, the Examples). Any method known in the art for eluting and recovering bound phage can be used. This method has been successfully used with the target molecules of BAFF, TfR and myostatin.

B. Biological Activities of Selected Synthetic VNAR Binding Moieties

The ability of selected synthetic VNAR binding moieties to inhibit BAFF biological activity was tested in a mouse splenocyte survival assay where mouse splenic B cells were exposed to human BAFF in the presence or in the absence of a series of putative BAFF antagonist VNARs or HSA as a negative control (Example 9; FIG. 20). An IC50 was determined for five different BAFF-specific VNAR antagonists, ranging from 60 to 200 nM, which is in the same order of magnitude as to that of the endogenous BAFF receptor, BR3 (121 nM).

Figures 21A, 21B:
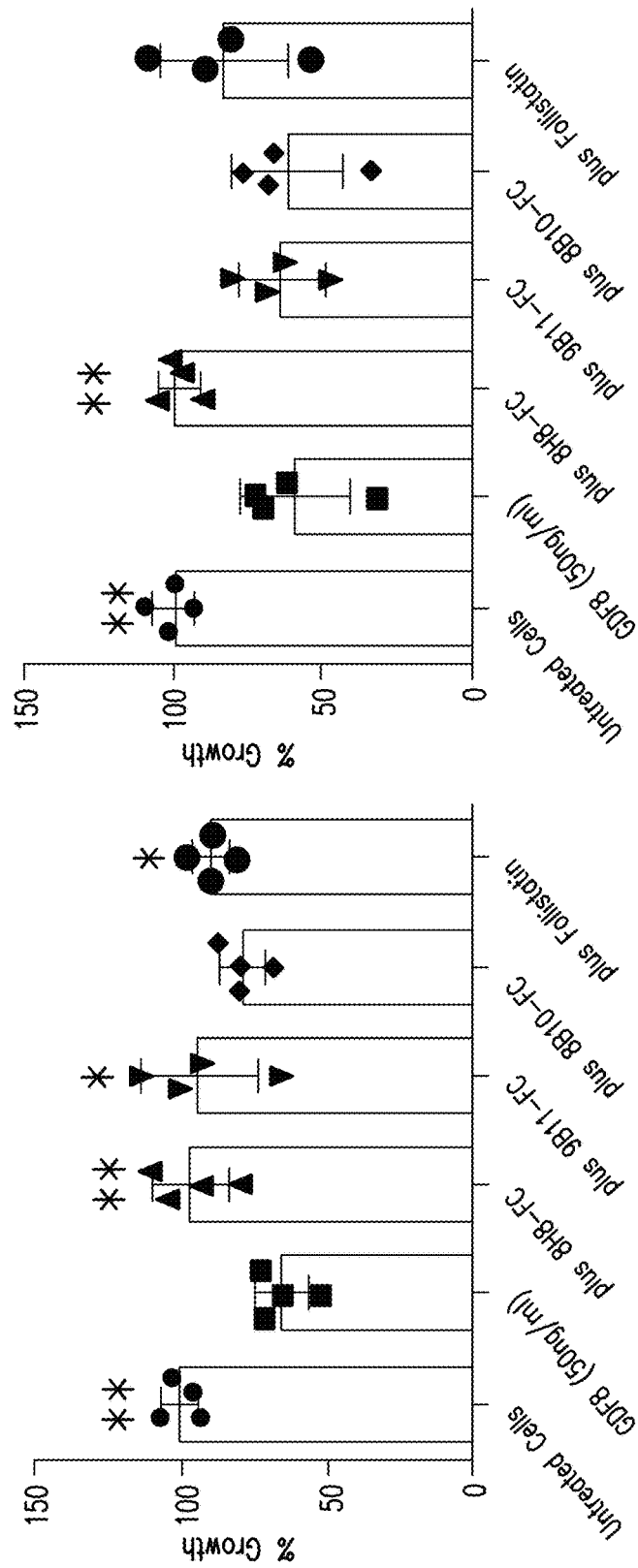

To test the effect of select myostatin-binding VNAR clones on myostatin biological activity, a cell based growth inhibition assay was performed (Example 10). Myostatin is capable of inhibiting growth of MPC11 cells in culture. As shown in FIG. 21A, two of the three VNAR-Fcs against myostatin selected from the OsX-3 library were as active as the endogenous inhibitor follistatin at 250 nM in reversing growth inhibition by myostatin. As shown in FIG. 21A, myostatin selective VNAR clone 8H8-Fc was more efficacious than follistatin and restored growth of MPC11 cells to control levels at a concentration of 50 nM. Significance was determined using the Dunnett's multiple comparison test for each group relative to cells in the presence of myostatin.

Select hTfR-binding VNAR clones were tested for effects on hTfR-1 biological activity in Example 11. CHO cells expressing recombinant human TfR-1 were incubated with VNAR monomers from clone 101G4 at either 4° C. or at 37° C. prior to fixation. Cells were stained with an anti-flag antibody followed by an A555-conjugated anti-mouse antibody and imaged by confocal microscopy. As shown in FIG. 22, the presumptive hTfR-1 specific VNAR binding moiety of clone 101G4 was able to bind to and be transported across the cell membrane by human TfR-1.

The libraries of the present invention were screened to identify binding moieties having high affinity to human BAFF, myostatin and TfR-1. BAFF is cytokine belonging to the tumor necrosis factor (TNF) superfamily, which consists of 19 ligands and 29 receptors in humans. TNF superfamily ligands and receptors are critical mediators that regulate immune cell functions including B cell homeostasis and activation, T cell co-stimulation, and natural killer cell regulation. Like most TNF ligands, BAFF is expressed as a type II transmembrane protein and its extracellular domain is cleaved to generate a soluble cytokine. BAFF binds with different affinities to three TNF family receptors, BAFF-R (BR3), TACI (transmembrane activator and calcium modulator and cyclophilin ligand interactor) and BCMA (B-cell maturation antigen), which are expressed at various stages of the B cell lineage. BAFF activation of these receptors through NF-kB signaling pathways promotes B-cells survival, proliferation and maturation.

Cytokines are a broad group of cellular mediators that include chemokines, interferons, interleukins, lymphokines and TNFs, which are critically important in the immune system. Cytokines that play a major role in the innate immune system include TNF-α, IL-1, IL-10, IL-12, type I interferons (IFN-α and IFN-β), IFN-γ, and chemokines. Cytokines that play a major role in the adaptive immune system include IL-2, IL-4, IL-5, TGF-β, IL-10 and IFN-γ. The IL-17 family of proinflammatory cytokines is associated with autoimmune diseases including multiple sclerosis, rheumatoid arthritis, and inflammatory bowel disease. Other cytokines, such as GM-CSF, M-CSF and G-CSF, promote the differentiation of hematopoietic stem cells.

Myostatin (also known as growth differentiation factor 8, GDF-8) is a secreted protein that inhibits muscle differentiation and growth. The active form of myostatin is produced by proteolytic cleavage of a synthesized as large precursor protein and consists of a 25 kDa dimer of two identical subunits, 109 amino acids each. Myostatin acts by autocrine mechanism since it is produced primarily by skeletal muscle cells, circulates in the blood to bind the, the activin type II receptor in specifically on muscle tissue. Myostatin binding recruits of the Alk4/5 coreceptor that then initiates a cell-signaling pathway involving the SMAD family of transcription factors.

Myostatin is a member of the transforming growth factor beta (TGF-β) superfamily, a large family of structurally related cell regulatory proteins that control proliferation, differentiation and other functions in many cell types. TGF-beta 1 was the first to be identified, but it has since been recognized that family member include not only the closely related proteins designated TGF-beta 2-5, but also a number of distantly related proteins that include the inhibins and activins, Nodal, Lefty, Mullerian inhibitory substance, the BMPs and GDFs, and the GDNF family. All ligands of the TGF-beta superfamily form dimers that bind to heterodimeric receptor complexes consisting of type I and type II receptor subunits with serine/threonine kinase domains. The type II receptor phosphorylates and activates the type I receptor upon ligand binding, initiating a Smad-dependent signaling cascade that induces or represses cell-specific gene transcription. Members of the TGF-beta family are required for the development of a variety of different tissues and organs by controlling dorso-ventral patterning, mesoderm induction and patterning, limb bud formation, bone and cartilage formation and neuronal and muscle differentiation.

In contrast, the human TfR-1 belongs to a class of membrane transport proteins, which move a wide variety of ions, nutrients, neurotransmitters, proteins and drugs across cell membranes. The three major classes of membrane transport proteins are ATP-powered pumps, channel proteins and transporters, which exhibit a high degree of specificity for the substance transported. The function of TfR-1 is to transport iron bound to transferrin from the blood to the liver, spleen, bone marrow, brain and other tissues. TfR-1 is also overexpressed in malignant cells and mediates higher iron uptake required for cell division. TfR-1 in a type II integral membrane glycoprotein composed of two disulfide-linked, 90 kDa polypeptides that transport transferrin via receptor-mediated endocytosis or transcytosis in the case of blood capillaries in the brain. Other receptors involved in macromolecular endocytosis or transcytosis include the Fc receptor for IgA, the low-density lipoprotein (LDL) receptor, receptors for most growth factors and hormones such as insulin, IGF-1, EGF, NGF, PDGF, and the asialoglycoprotein receptor which mediates endocytosis of plasma glycoproteins lacking a terminal sialic acid.

Accordingly, the invention provides powerful methods for screening and selecting a synthetic VNAR binding moiety with binding specificity directed to one or more of any number of desired molecular target molecules. VNAR libraries may be screened and clones comprising putative binding moiety sequences (polypeptide and/or nucleic acid) may be enriched, purified and tested in whatever in vitro and in vivo biological assays are known and available to the art for the particular molecular target molecule of interest. Once molecular target-binding clones are isolated, polypeptide and/or nucleic acid molecules encoding the synthetic VNAR binding moieties may be identified and optionally isolated. One of skill in the art can use standard genetic and molecular engineering, e.g., affinity maturation and other well-known techniques to optimize the characteristics of the binding moiety for its intended purpose, e.g., to produce improved diagnostic agents or therapeutic versions by making sequence variants and derivatives expected to be more potent or otherwise more drug-like with respect to half-life, pK, solubility, bioavailability, cellular or tissue targeting, in vivo clearance and the like.

C. Polypeptide Sequences and Compounds Comprising Synthetic VNAR Binding Moieties The present invention provides a molecular target specific binding moiety, e.g., polypeptide, and a molecular target regulatory compound ("MTRC"), e.g., a molecular target antagonist compound ("MTAC") comprising a molecular target specific VNAR binding moiety. Isolated molecular target specific binding VNARs and compositions comprising them are also provided. In certain embodiments, the molecular target specific binding moiety or a MTRC or MTAC comprising it is specific for a mammalian molecular target. In certain embodiments, the target binding moiety or a MTRC or MTAC comprising it is specific for a human molecular target. In certain embodiments, the target specific binding moiety or a MRTC or MTAC comprising it blocks the interaction between a human receptor and it cognate ligand or otherwise between molecular binding partners. In other embodiments, the target specific binding moiety blocks the interaction between homo- or hetero-dimers comprising the target molecule.

In certain embodiments, the binding activity of a binding moiety or a MTRC or MTAC comprising a binding moiety toward a select molecular target is at least 3-fold higher than to a negative control, e.g., human serum albumin or to any other negative control protein. According to the present invention, selective binding may be quantified in terms of a binding ratio (a/b) of (a) binding to a target molecule of interest to (b) binding to a negative control or reference protein. In certain embodiments, a binding ratio indicative of selective binding to a target molecule (or a soluble domain thereof) is at least 3-fold, 5-fold, 10-fold, 15-fold, 20-fold, 25-fold, 30-fold, 40-fold, 50-fold, 75-fold, 100-fold, 250-fold, 500-fold, 750-fold, 1000-fold, 2500-fold, 5000-fold or higher. Selective binding assays may be performed according to the examples disclosed herein or one of numerous molecular binding assays available in the art (e.g., in vitro or cell based binding assays).

The libraries of the present invention were screened to identify binding moieties having high affinity to BAFF, myostatin and hTrR-1. As described above, human BAFF is a cytokine belonging to the tumor necrosis factor (TNF) superfamily, myostatin is a member of the transforming growth factor beta (TGF-β) superfamily, and human TfR-1 belongs to a class of membrane transport proteins that move a wide variety of ions, nutrients, neurotransmitters, proteins and drugs across cell membranes. It will be understood that any of a number of different molecules well known in the art may be a desirable molecular target for which to design a synthetic VNAR binding moiety or a MTRC or MTAC comprising it, as long as blocking or otherwise altering expression of the target molecule is shown or predicted to have a therapeutic benefit.

The bioactivity of a synthetic VNAR binding moiety, or a MTRC or MTAC of the invention may in certain embodiments be determined by one or more assays used to measure an activity which is either antagonism or agonism by an antibody. In certain embodiments, binding of the synthetic VNAR binding moiety, MTRC or MTAC to a molecular target is measured by a well-known immunoassay, such as for example an ELISA as described, e.g., in Examples 4 and 8 herein. Any other binding assay which measures direct or indirect interaction of the synthetic VNAR binding moiety, MTRC or MTAC to its molecular target, or alternatively, which measure the ability of a synthetic VNAR binding moiety, MTRC or MTAC of the invention to compete for binding to a molecular target in the presence of a different MTRC or MTAC (such as an antibody) such as by a competitive inhibition assay, may be used. Preferably, a selected assay measures the effect of a synthetic VNAR binding moiety, MTRC or MTAC of the invention on at least one biological effect of native ligand and in certain embodiments, compares the effect to that of another molecular target binding agent, e.g., to an antibody.

Results of cellular in vitro assays may be further verified using one or more in vivo animal models. A variety of accepted animal models of diseases or cancers may be used to characterize, e.g., test the efficacy of, a synthetic VNAR binding moiety, MTRC or MTAC (or compositions thereof) of the invention. Animal models of diseases include both non-recombinant and recombinant (transgenic) animals.

According to another embodiment, a synthetic VNAR binding moiety, MTRC or MTAC of the invention binds to its cognate molecular target in a standard ELISA or other similar assay with an EC50 of 300 nM or less, and preferably 100 nM or less, 10 nM or less, or 1 nM or less. Thus, a MTAC of the invention binds to molecular target in a standard ELISA or other similar assay with an EC50 in a range of 0.1 nM to 300 nM, 0.5 nM to 300 nM, 1 nM to 300 nM, 10 nM to 300 nM, 50 nM to 300 nM, 100 nM to 300 nM, 0.1 nM to 100 nM, 0.5 nM to 100 nM, 1 nM to 100 nM, 5 nM to 100 nM, 10 nM to 100 nM, 0.1 nM to 50 nM, 0.5 nM to 50 nM, 1 nM to 50 nM, 5 nM to 50 nM, 10 nM to 50 nM.

According to another embodiment, a synthetic VNAR binding moiety, MTRC or MTAC of the invention competes with another antibody specific for binding to its molecular target in a standard ELISA or other similar assay with an IC50 of 1 micromolar or less, 500 nM or less, and preferably 100 nM or less, 50 nM or less, 25 nM or less, 10 nM or less, or 1 nM or less. Thus, a synthetic VNAR binding moiety, MTRC or MTAC of the invention competes for binding to its molecular target in a standard ELISA or other similar assay with an IC50 in a range of 0.1 nM to 1 micromolar, 1 nM to 1 micromolar, 10 nM to 1 micromolar, 100 nM to 1 micromolar, 0.1 nM to 500 nM, 0.5 nM to 500 nM, 1 nM to 500 nM, 10 nM to 500 nM, 50 nM to 500 nM, 100 nM to 500 nM, 250 nM to 500 nM, 0.1 nM to 250 nM, 0.5 nM to 250 nM, 1 nM to 250 nM, 5 nM to 250 nM, 10 nM to 250 nM, 50 nM to 250 nM, 100 nM to 250 nM, 0.1 nM to 100 nM, 0.5 nM to 100 nM, 1 nM to 100 nM, 5 nM to 100 nM, 10 nM to 100 nM, 0.1 nM to 50 nM, 0.5 nM to 50 nM, 1 nM to 50 nM, or 10 nM to 50 nM.

Therapeutic versions of the invention include other molecular configurations, e.g., VNAR monomers fused to stabilizing heterologous peptide regions, e.g., the Fc domain of an IgG or other immunoglobulin molecule, which may be expressed and then further purified as multimers, such as covalent dimers. We envision that the activity of certain such therapeutic molecules will have even greater potency, preferably by at least 2-10 fold higher potencies.

Pharmaceutically acceptable salts or solvates of any of the molecular target specific synthetic VNAR binding moieties, or MTRC or MTACs of the invention are likewise within the scope of the present invention.

As used herein, the term "pharmaceutically acceptable salt" refers to a salt that is not harmful to a patient or subject to which the salt in question is administered. It may be a salt chosen, e.g., among acid addition salts and basic salts. Examples of acid addition salts include chloride salts, citrate salts and acetate salts. Examples of basic salts include salts wherein the cation is selected from alkali metal cations, such as sodium or potassium ions, alkaline earth metal cations, such as calcium or magnesium ions, as well as substituted ammonium ions, such as ions of the type N(R1)(R2)(R3)(R4)+, wherein R1, R2, R3 and R4 independently will typically designate hydrogen, optionally substituted $C_{1-6}$-alkyl groups or optionally substituted $C_{2-6}$-alkenyl groups. Examples of relevant $C_{1-6}$-alkyl groups include methyl, ethyl, 1-propyl and 2-propyl groups. Examples of $C_{2-6}$-alkenyl groups of possible relevance include ethenyl, 1-propenyl and 2-propenyl. Other examples of pharmaceutically acceptable salts are described in "Remington's Pharmaceutical Sciences", 17th edition, Alfonso R. Gennaro (Ed.), Mark Publishing Company, Easton, Pa., USA, 1985 (and more recent editions thereof), in the "Encyclopaedia of Pharmaceutical Technology", 3rd edition, James Swarbrick (Ed.), Informa Healthcare USA (Inc.), NY, USA, 2007, and in J. Pharm. Sci. 66: 2 (1977).

The term "solvate" in the context of the present invention refers to a complex of defined stoichiometry formed between a solute (in casu, a peptide compound or pharmaceutically acceptable salt thereof according to the invention) and a solvent. The solvent in this connection may, for example, be water, ethanol or another pharmaceutically acceptable, typically small-molecular organic species, such as, but not limited to, acetic acid or lactic acid. When the solvent in question is water, such a solvate is normally referred to as a hydrate.

In each of the sequences described above, and in each sequence described herein, a C-terminal "—OH" moiety may be substituted for a C-terminal "—NH$_2$" moiety, and vice-versa.

Each of the specific compounds of the invention (e.g., molecular target molecule binding moieties, antagonist peptides and compounds), and pharmaceutically acceptable salts and solvates thereof, constitutes an individual embodiment of the invention.

Molecular target specific synthetic VNAR binding moieties, MTRCs and MTACs of the invention may optionally be conjugated to one or more additional agents which may include therapeutic and/or diagnostic agents. Such agents include but are not limited to chemotherapeutics such as cytostatic drugs, cytotoxins, radioisotopes, chelators, enzymes, nucleases, nucleic acids such as DNA, RNA or mixed nucleic acid oligonucleotides, including siRNAs, shRNAs, microRNAs, aptamers and the like; immunomodulators such as therapeutic antibodies, antibody and antibody-like fragments, inflammatory and anti-inflammatory cytokines, anti-inflammatory agents, radiotherapeutics, photoactive agents, diagnostic markers and the like.

The invention further provides methods of making derivatives of molecular target specific synthetic VNAR binding moieties, MTRCs and MTACs of the invention using biochemical engineering techniques well known to those of skill in the art. Such derivatives include, inter alia, multivalent or multispecific molecules comprising a specific binding moiety, including immunoconjugates. A large body of art is available relating to how to make and use antibody drug conjugates. Such knowledge and skill in the art may be adapted for use with the target specific binding moieties, MTRCs and MTACs of the invention. See, e.g., WO2007/140371; WO2006/068867 specific to BAFF; methods relating to making and/or using different ligand antagonist conjugates may be applied. In certain embodiments, the molecular target selective binding moieties, MTRCs and MTACs of the present invention include covalently modified and conjugated polypeptides forms of the polypeptides (e.g., immunoadhesins, radiolabeled or fluorescently labeled compounds, and the like). Methods for peptide conjugation and for labeling polypeptides and conjugating molecules are well known in the art.

D. Pharmaceutical Compositions

The present invention further provides pharmaceutical compositions comprising a molecular target specific binding moiety or compound, or a pharmaceutically acceptable salt or solvate thereof, according to the invention, together with a pharmaceutically acceptable carrier, excipient or vehicle.

Accordingly, the present invention further provides a pharmaceutical composition comprising a molecular target specific binding moiety, MTRC or a MTAC. Certain embodiments of the pharmaceutical compositions of the invention are described in further detail below.

The present invention also provides pharmaceutical compositions comprising a molecular target specific binding moiety, MTRC or a MTAC for use in treating, ameliorating or preventing one or more diseases, conditions, disorders or symptoms relating to aberrant expression or activity of the molecular target in a cell or tissue, as described in further detail below. Each such disease, condition, disorder or symptom is envisioned to be a separate embodiment with respect to uses of a pharmaceutical composition according to the invention. It is envisioned that a wide range of diseases, disorders or conditions may benefit from the compounds and methods of the invention, including but not limited to treatments of B- and T-cell cancers or proliferation disorders, inflammatory conditions, prevention of organ transplant rejections, autoimmune disorders, microbial (e.g., viral, bacterial or fungal) infections and the like. Any disease, disorder or condition in which modulating a biochemical signaling pathway involved in under- or over-expression of a biochemical entity that mediates a disease or condition, or disrupting aberrant homo- or heteromeric complex formation relating to a disease or condition may also be amenable to the design of a target specific binding moiety, MTRC or MTAC of the invention.

E. Nucleic Acid Sequences That Encode a Molecular Target Selective Binding Moiety or MTAC In one aspect, the invention provides an isolated nucleic acid which encodes a molecular target specific binding moiety, MTRC or MTAC of the invention, or a fragment or derivative thereof. In certain embodiments, the invention provides a composition comprising a plurality of nucleic acid molecules which encode a plurality of polypeptides at least one of which comprises molecular target specific binding moiety, MTRC or MTAC of the invention, or a fragment or derivative thereof. In certain embodiments, the invention provides a composition comprising a plurality of nucleic acid molecules encoding at least 50 different polypeptides. Nucleic acid molecules comprising sequences that are complementary to molecular target specific binding moiety encoding sequences such as of the above described nucleic acid molecules are also provided.

In another aspect, the invention provides an isolated nucleic acid molecule encoding a fusion protein comprising at least two segments, wherein one of the segments comprises a polypeptide or fragment thereof having CDR1, CDR3 or framework amino acid sequences shown in Table 1, and variants thereof according to the invention. In certain embodiments, a second segment comprises a heterologous signal polypeptide, a heterologous binding moiety, an immunoglobulin fragment such as a Fc domain, or a detectable marker.

One aspect of the invention provides isolated nucleic acid molecules that encode molecular target specific binding moiety proteins or biologically active portions thereof. Also included are nucleic acid fragments sufficient for use as hybridization probes to identify binding moiety encoding nucleic acids and fragments for use as polymerase chain reaction (PCR) primers for the amplification or mutation of specific binding moiety encoding nucleic acid molecules.

As used herein, the term "nucleic acid molecule" is intended to include DNA molecules, RNA molecules (e.g., mRNA, shRNA, siRNA, microRNA), analogs of the DNA or RNA generated using nucleotide analogs, and derivatives, fragments and homologs thereof. The nucleic acid molecules of the invention may be single-, double-, or triple-stranded. A nucleic acid molecule of the present invention, e.g., a nucleic acid molecule encoding any one of the amino acid sequences disclosed in Table 1, or a complement of any of these nucleotide sequences, may be isolated using sequence information provided herein and well known molecular biological techniques (e.g., as described in Sambrook et al., Eds., MOLECULAR CLONING: A LABORATORY MANUAL 2ND ED., Cold Spring Harbor Laboratory Press, Cold Spring Harbor, N.Y., 1989; and Ausubel, et al., Eds., CURRENT PROTOCOLS IN MOLECULAR BIOLOGY, John Wiley & Sons, New York, N.Y., 1993).

A nucleic acid molecule of the invention may be amplified using any form of nucleic acid template and appropriate oligonucleotide primers according to standard PCR amplification techniques. Amplified nucleic acid may be cloned into an appropriate vector and characterized, e.g., by restriction analysis or DNA sequencing. Furthermore, oligonucleotides corresponding to nucleotide sequences that encode a selective binding moiety or MTAC of the invention may be prepared by standard synthetic techniques, e.g., using an automated DNA synthesizer.

The term "oligonucleotide" as used herein refers to a series of covalently linked nucleotide (or nucleoside residues, including ribonucleoside or deoxyribonucleoside residues) wherein the oligonucleotide has a sufficient number of nucleotide bases to be used in a PCR reaction. Oligonucleotides comprise portions of a nucleic acid sequence having at least about 10 nucleotides and as many as 50 nucleotides, preferably about 15 nucleotides to 30 nucleotides. Oligonucleotides may be chemically synthesized and may be used as probes. A short oligonucleotide sequence may be used to amplify, confirm, or reveal the presence of an identical, similar or complementary DNA or RNA in a particular cell or tissue.

Derivatives or analogs of the nucleic acid molecules (or proteins) of the invention include, inter alia, nucleic acid (or polypeptide) molecules having regions that are substantially homologous to the nucleic acid molecules or proteins of the invention, e.g., by at least about 45%, 50%, 70%, 80%, 95%, 98%, or even 99% identity (with a preferred identity of 80-99%) over a nucleic acid or amino acid sequence of the same size or when compared to an aligned sequence in which the alignment is done by a computer homology program known in the art. Also included are nucleic acid molecules capable of hybridizing to the complement of a sequence encoding the proteins of the invention under stringent or moderately stringent conditions. See e.g. Ausubel, et al., CURRENT PROTOCOLS IN MOLECULAR BIOLOGY, John Wiley & Sons, New York, N.Y., 1993, and below. An exemplary program is the GAP program (Wisconsin Sequence Analysis Package, Version 8 for UNIX, Genetics Computer Group, University Research Park, Madison, Wis.) using the default settings, which uses the algorithm of Smith and Waterman (1981) Adv. Appl. Math. 2:482489). Derivatives and analogs may be full length or other than full length, if the derivative or analog contains a modified nucleic acid or amino acid, as described below.

Stringent conditions are known to those skilled in the art and may be found in CURRENT PROTOCOLS IN MOLECULAR BIOLOGY, John Wiley & Sons, N.Y. (1989), 6.3.1-6.3.6. In certain embodiments, stringent conditions typically permit sequences at least about 65%, 70%, 75%, 85%, 90%, 95%, 98%, or 99% homologous to each other to remain hybridized to each other. A non-limiting example of stringent hybridization conditions is hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C. This hybridization is followed by one or more washes in 0.2×SSC, 0.01% BSA at 50° C. The term "stringent hybridization conditions" as used herein refers to conditions under which a nucleic acid probe, primer or oligonucleotide will hybridize to its target sequence, but only negligibly or not at all to other nucleic acid sequences. Stringent conditions are sequence- and length-dependent, and depend on % (percent)-identity (or %-mismatch) over a certain length of nucleotide residues. Longer sequences hybridize specifically at higher temperatures than shorter sequences. Generally, stringent conditions are selected to be about 5° C. lower than the thermal melting point (Tm) for the specific sequence at a defined ionic strength and pH. Stringent conditions may also be achieved with the addition of destabilizing agents, such as formamide.

F. Methods of Producing Specific VNAR Binding Moieties and Antagonists

The molecules and compounds of the invention may be manufactured by standard synthetic methods, by use of recombinant expression systems, or by any other suitable method. Thus, the compounds may be synthesized in a number of ways, including, e.g., methods comprising: (1) synthesizing a polypeptide or polypeptide component of a molecular target regulatory or antagonist compound (MTRC or MTAC, respectively) using standard solid-phase or liquid-phase methodology, either stepwise or by fragment assembly, and isolating and purifying the final peptide compound product; (2) expressing a nucleic acid construct that encodes a polypeptide or polypeptide component of a MTRC or MTAC in a host cell and recovering the expression product from the host cell or host cell culture; or (3) cell-free in vitro expression of a nucleic acid construct encoding a polypeptide or polypeptide component of a MTRC or MTAC, and recovering the expression product; or by any combination of the methods of (1), (2) or (3) to obtain fragments of the peptide component, subsequently joining (e.g., ligating) the fragments to obtain the peptide component, and recovering the peptide component.

It may be preferable to synthesize a polypeptide or polypeptide component of a MTRC or MTAC of the invention by means of solid-phase or liquid-phase peptide synthesis. Compounds of the invention may suitably be manufactured by standard synthetic methods. Thus, peptides may be synthesized by, e.g., methods comprising synthesizing the peptide by standard solid-phase or liquid-phase methodology, either stepwise or by fragment assembly, and isolating and purifying the final peptide product. In this context, reference may be made to WO1998/11125 or, inter alia, Fields, G. B. et al., "Principles and Practice of Solid-Phase Peptide Synthesis"; in: Synthetic Peptides, Gregory A. Grant (ed.), Oxford University Press (2nd edition, 2002) and the synthesis examples herein.

Accordingly, the present invention also provides methods for producing a molecular target specific binding polypeptide of the invention according to above recited methods; a nucleic acid molecule encoding part or all of a polypeptide of the invention, a vector comprising at least one nucleic acid of the invention, expression vectors comprising at least one nucleic acid of the invention capable of producing a polypeptide of the invention when introduced into a host cell, and a host cell comprising a nucleic acid molecule, vector or expression vector of the invention.

MTRCs or MTACs of the invention may be prepared using recombinant techniques well known in the art. In general, methods for producing polypeptides by culturing host cells transformed or transfected with a vector comprising the encoding nucleic acid and recovering the polypeptide from cell culture are described in, e.g., Sambrook et al., Molecular Cloning: A Laboratory Manual (New York: Cold Spring Harbor Laboratory Press, 1989); Dieffenbach et al., PCR Primer: A Laboratory Manual (Cold Spring Harbor Laboratory Press, 1995).

A nucleic acid encoding a desired polypeptide may be inserted into a replication vector for further cloning (amplification) of the DNA or for expression of the nucleic acid into RNA and protein. A multitude of cloning and expression vectors are publicly available.

Expression vectors capable of directing transient or stable expression of genes to which they are operably linked are well known in the art. The vector components generally include, but are not limited to, one or more of the following: a heterologous signal sequence or peptide, an origin of replication, one or more marker genes, an enhancer element, a promoter, and a transcription termination sequence, each of which is well known in the art. Optional regulatory control sequences, integration sequences, and useful markers that can be employed are known in the art.

Any suitable host cell may be used to produce MTRCs or MTACs of the invention. Host cells may be cells stably or transiently transfected, transformed, transduced or infected with one or more expression vectors which drive expression of a polypeptide of the invention. Suitable host cells for cloning or expressing nucleic acids of the invention include prokaryote, yeast, or higher eukaryote cells. Eukaryotic microbes such as filamentous fungi, yeast, *Arabidopsis*, and other algal, plant and animal eukaryotic host cells that may be grown in liquid culture are suitable cloning or expression hosts for vectors. Suitable host cells for the expression of glycosylated polypeptides may also be derived from multicellular organisms.

Creation and isolation of host cell lines producing a MTRC or MTAC of the invention can be accomplished using standard techniques known in the art. Mammalian cells are preferred host cells for expression of peptide antagonists. Particularly useful mammalian cells include, inter alia, HEK 293, NSO, DG-44, and CHO cells, but any other suitable host cell may be used according to the invention. Preferably, the target binding moiety or MTRC or MTAC comprising it is secreted into the medium in which the host cells are cultured, from which the antagonist compounds may be recovered or purified.

When a polypeptide is produced in a recombinant cell other than one of human origin, it is typically free of polypeptides of human origin. In certain embodiments, it is advantageous to separate a polypeptide away from other recombinant cell components such as host cell polypeptides to obtain preparations that are of high purity or substantially homogeneous. As a first step, culture medium or cell lysates may be centrifuged to remove particulate cell debris and suitable protein purification procedures may be performed. Such procedures include, inter alia, fractionation (e.g., size separation by gel filtration or charge separation by ion-exchange column); ethanol precipitation; Protein A Sepharose columns to remove contaminants such as IgG; hydrophobic interaction chromatography; reverse phase HPLC; chromatography on silica or on cation-exchange resins such as DEAE and the like; chromatofocusing; electrophoretic separations; ammonium sulfate precipitation; gel filtration using, for example, Sephadex beads such as G-75. Any number of biochemical purification techniques may be used to increase the purity of a molecular target specific binding moiety, or MTRC or MTAC of the invention.

G. Methods of Detection

In certain embodiments, the antagonist compounds of the invention may be used to detect and quantify levels of a molecular target molecule of interest, or cells that express a binding partner to that target molecule. This can be achieved, for example, by contacting a test sample (such as an in vitro sample) and a control sample with a target specific binding moiety of the invention, or a MTRC or MTAC comprising it, under conditions which permit formation of a complex between the antagonist and the target, or between the target and a different binding partner, or both. Any bound target complexes are detected and/or quantified in specific VNAR containing samples and control samples.

Accordingly, the invention further provides methods for detecting the presence of a molecular target molecule or a binding partner of that target molecule in a sample, or measuring the amount of either of the foregoing, comprising contacting the sample, and preferably a control sample, with a target specific regulatory, e.g., antagonist compound of the invention under conditions that permit complex formation between the synthetic VNAR binding moiety of the MTRC or MTAC and the molecular target molecule. Formation or inhibition of formation of a bound complex is then detected and/or quantified. A variety of tests may be designed based on features of binding or competition for binding. For example, the presence of a molecular target molecule or its native binding partner in a test sample may be detected directly, or may be detected and quantified based on the ability to compete for binding by adding a MTRC or MTAC of the invention. In general, the difference in complex formation between a test sample and a control sample is indicative of a binding interaction.

H. Kits for Detecting or Quantifying Molecular Target Molecules in a Sample

Also within the scope of the invention are kits comprising at least one target molecule specific binding moiety, MTRC or MTAC or composition of the invention, and optionally, instructions for use. Kits may be useful for quantifying target molecules and/or their binding partners in a sample, or may be useful for detection, such as in diagnostics methods. The kit may further or alternatively comprise at least one nucleic acid encoding a target specific binding moiety of the invention. A kit of the invention may optionally comprise at least one additional reagent (e.g., standards, markers and the like). Kits typically include a label indicating the intended use of the contents of the kit. The kit may further comprise reagents and other tools for measuring a target molecule of interest in a sample or in a subject, or for diagnosing whether a patient belongs to a group that responds to an antagonist of the invention which makes use of a compound, composition or related method of the invention as described herein.

I. Methods of Treatment Using Molecular Target Antagonists and Compositions

The present invention provides a molecular target regulatory compound (MTRC) e.g., antagonist compound (MTAC) for use, alone or in combination with one or more additional therapeutic agents in a pharmaceutical composition, for treatment or prophylaxis of conditions, diseases and disorders responsive to modulation (such as inhibiting or blocking) of the interaction between the molecular target and one or more of its native binding agents in a cell.

MTRCs or MTACs and pharmaceutical compositions of the invention may be used in the treatment of a variety of conditions, disorders or diseases which benefit from disruption or antagonism of a biological pathway or a molecular interaction that is affected (e.g., antagonized) by treating with a synthetic VNAR binding moiety comprising molecule or composition of the invention.

As used herein, an "effective amount," a "therapeutically effective amount" or an "effective dose" is an amount of a composition (e.g., a therapeutic composition or agent) that produces at least one desired therapeutic effect in a subject, such as preventing or treating a target condition or beneficially alleviating a symptom associated with the condition. The most desirable therapeutically effective amount is an amount that will produce a desired efficacy of a particular treatment selected by one of skill in the art for a given subject in need thereof. This amount will vary depending upon a variety of factors understood by the skilled worker, including but not limited to the characteristics of the therapeutic compound (including activity, pharmacokinetics, pharmacodynamics, and bioavailability), the physiological condition of the subject (including age, sex, disease type and stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, namely by monitoring a subject's response to administration of a compound and adjusting the dosage accordingly. See, e.g., Remington: The Science and Practice of Pharmacy 21st Ed., Univ. of Sciences in Philadelphia (USIP), Lippincott Williams & Wilkins, Philadelphia, Pa., 2005.

The molecular target specific binding moieties, MTRCs and MTACs and related compositions of the invention may be used in the manufacture of a pharmaceutical composition or medicament for the treatment of one or more conditions, diseases and disorders associated with aberrant bioactivity of the cognate molecular target in a cell or tissue of a subject, e.g., a human patient.

J. Formulations, Administration and Dosing

Molecular target regulatory compounds (MTRCs) e.g., antagonist compounds (MTACs) of the present invention, or salts thereof, may be formulated as pharmaceutical compositions prepared for storage or administration, which typically comprise a therapeutically effective amount of a compound of the invention, or a salt thereof, in a pharmaceutically acceptable carrier.

The therapeutically effective amount of a compound of the present invention will depend on the route of administration, the type of mammal being treated, and the physical characteristics of the specific mammal under consideration. These factors and their relationship to determining this amount are well known to skilled practitioners in the medical arts. This amount and the method of administration can be tailored to achieve optimal efficacy, and may depend on such factors as weight, diet, concurrent medication and other factors, well known to those skilled in the medical arts. The dosage sizes and dosing regimen most appropriate for human use may be guided by the results obtained by the present invention, and may be confirmed in properly designed clinical trials.

An effective dosage and treatment protocol may be determined by conventional means, starting with a low dose in laboratory animals and then increasing the dosage while monitoring the effects, and systematically varying the dosage regimen as well. Numerous factors may be taken into consideration by a clinician when determining an optimal dosage for a given subject. Such considerations are known to the skilled person. The term "pharmaceutically acceptable carrier" includes any of the standard pharmaceutical carriers. Pharmaceutically acceptable carriers for therapeutic use are well known in the pharmaceutical art, and are described, for example, in Remington's Pharmaceutical Sciences, Mack Publishing Co. (A. R. Gennaro edit. 1985). For example, sterile saline and phosphate-buffered saline at slightly acidic or physiological pH may be used. pH buffering agents may be phosphate, citrate, acetate, tris/hydroxymethyl)aminomethane (TRIS), N-Tris(hydroxymethyl)methyl-3-aminopropanesulphonic acid (TAPS), ammonium bicarbonate, diethanolamine, histidine, which is a preferred buffer, arginine, lysine, or acetate or mixtures thereof. The term further encompasses any agents listed in the US Pharmacopeia for use in animals, including humans.

The term "pharmaceutically acceptable salt" refers to the salt of the compounds. Salts include pharmaceutically acceptable salts such as acid addition salts and basic salts. Examples of acid addition salts include hydrochloride salts, citrate salts and acetate salts. Examples of basic salts include salts where the cation is selected from alkali metals, such as sodium and potassium, alkaline earth metals such as calcium, and ammonium ions $^+N(R^3)_3(R^4)$, where $R^3$ and $R^4$ independently designate optionally substituted $C_{1-6}$-alkyl, optionally substituted $C_{2-6}$-alkenyl, optionally substituted aryl, or optionally substituted heteroaryl. Other examples of pharmaceutically acceptable salts are described in "Remington's Pharmaceutical Sciences", 17th edition. Ed. Alfonso R. Gennaro (Ed.), Mark Publishing Company, Easton, Pa., U.S.A., 1985 and more recent editions, and in the Encyclopaedia of Pharmaceutical Technology.

"Treatment" is an approach for obtaining beneficial or desired clinical results. For the purposes of this invention, beneficial or desired clinical results include, but are not limited to, alleviation of symptoms, diminishment of extent of disease, stabilized (i.e., not worsening) state of disease, delay or slowing of disease progression, amelioration or palliation of the disease state, and remission (whether partial or total), whether detectable or undetectable. "Treatment" can also mean prolonging survival as compared to expected survival if not receiving treatment. "Treatment" is an intervention performed with the intention of preventing the development or altering the pathology of a disorder. Accordingly, "treatment" refers to both therapeutic treatment and prophylactic or preventative measures in certain embodiments. Those in need of treatment include those already with the disorder as well as those in which the disorder is to be prevented. By treatment is meant inhibiting or reducing an increase in pathology or symptoms when compared to the absence of treatment, and is not necessarily meant to imply complete cessation of the relevant condition.

The pharmaceutical compositions can be in unit dosage form. In such form, the composition is divided into unit doses containing appropriate quantities of the active component. The unit dosage form can be a packaged preparation, the package containing discrete quantities of the preparations, for example, packeted tablets, capsules, and powders in vials or ampoules. The unit dosage form can also be a capsule, cachet, or tablet itself, or it can be the appropriate number of any of these packaged forms. It may be provided in single dose injectable form, for example in the form of a pen. Compositions may be formulated for any suitable route and means of administration.

Pharmaceutically acceptable carriers or diluents include those used in formulations suitable for oral, rectal, nasal or parenteral (including subcutaneous, intramuscular, intravenous, intradermal, and transdermal) administration. The formulations may conveniently be presented in unit dosage form and may be prepared by any of the methods well known in the art of pharmacy. Subcutaneous or transdermal modes of administration may be particularly suitable for the compounds described herein.

An acceptable route of administration may refer to any administration pathway known in the art, including but not limited to aerosol, enteral, nasal, ophthalmic, oral, parenteral, rectal, vaginal, or transdermal (e.g., topical administration of a cream, gel or ointment, or by means of a transdermal patch). "Parenteral administration" is typically associated with injection at or in communication with the intended site of action, including infraorbital, infusion, intraarterial, intracapsular, intracardiac, intradermal, intramuscular, intraperitoneal, intrapulmonary, intraspinal, intrasternal, intrathecal, intrauterine, intravenous, subarachnoid, subcapsular, subcutaneous, transmucosal, or transtracheal administration.

In another aspect, the present invention provides a composition, e.g., a pharmaceutical composition, comprising one or a combination of different MTRC or MTAC compounds of the invention, or synthetic VNAR sequences comprising a molecular target specific binding region thereof, or an ester, salt or amide of any of the foregoing, and at least one pharmaceutically acceptable carrier. Such compositions may include one or more different target specific binding moieties or compounds in combination to produce an immunoconjugate or multi-specific molecule comprising at least one molecular target specific binding moiety. For example, a pharmaceutical composition of the invention may comprise a combination of molecular target specific binding moieties which bind to different epitopes of the target or which otherwise have complementary biological activities.

Pharmaceutical compositions of the invention may be administered alone or in combination with one or more other therapeutic or diagnostic agents. A combination therapy may include a MTRC or MTAC of the present invention combined with at least one other therapeutic agent selected based on the particular patient, disease or condition to be treated. Examples of other such agents include, inter alia, a cytotoxic, anti-cancer or chemotherapeutic agent, an anti-inflammatory or anti-proliferative agent, an antimicrobial or antiviral agent, growth factors, cytokines, an analgesic, a therapeutically active small molecule or polypeptide, a single chain antibody, a classical antibody or fragment thereof, or a nucleic acid molecule which modulates one or more signaling pathways, and similar modulating therapeutics which may complement or otherwise be beneficial in a therapeutic or prophylactic treatment regimen.

As used herein, "pharmaceutically acceptable carrier" includes any and all physiologically acceptable, i.e., compatible, solvents, dispersion media, coatings, antimicrobial agents, isotonic and absorption delaying agents, and the like.

In certain embodiments, the carrier is suitable for intravenous, intramuscular, subcutaneous, parenteral, spinal or epidermal administration (e.g., by injection or infusion). Depending on selected route of administration, the molecular target specific binding moiety comprising compound or component may be coated in a material or materials intended to protect the compound from the action of acids and other natural inactivating conditions to which the active molecular target binding moiety may encounter when administered to a subject by a particular route of administration.

As above, a compound of the invention may encompass one or more pharmaceutically acceptable salts. As used herein a "pharmaceutically acceptable salt" retains qualitatively a desired biological activity of the parent compound without imparting any undesired effects relative to the compound. Examples of pharmaceutically acceptable salts include acid addition salts and base addition salts. Acid addition salts include salts derived from nontoxic inorganic acids, such as hydrochloric, nitric, phosphorous, phosphoric, sulfuric, hydrobromic, hydroiodic and the like, or from nontoxic organic acids such as aliphatic mono- and di-carboxylic acids, phenyl-substituted alkanoic acids, hydroxy alkanoic acids, aromatic acids, aliphatic and aromatic sulfonic acids and the like. Base addition salts include salts derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition of the invention also optionally includes a pharmaceutically acceptable antioxidant. Exemplary pharmaceutically acceptable antioxidants are water soluble antioxidants such as ascorbic acid, cysteine hydrochloride, sodium bisulfate, sodium metabisulfite, sodium sulfite and the like; oil-soluble antioxidants, such as ascorbyl palmitate, butylated hydroxyanisole (BHA), butylated hydroxytoluene (BHT), lecithin, propylgallate, alpha-tocopherol, and the like; and metal chelating agents, such as citric acid, ethylenediamine tetraacetic acid (EDTA), sorbitol, tartaric acid, phosphoric acid, and the like.

Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyloleate. Proper fluidity can be maintained, for example, by the use of coating materials, such as lecithin, by the maintenance of the required particle size in the case of dispersions, and by the use of surfactants.

Target molecule regulatory, e.g., antagonist compositions may also contain adjuvants such as preservatives, wetting agents, emulsifying agents and dispersing agents. Prevention of presence of microorganisms may be ensured both by sterilization procedures, and by the inclusion of various antibacterial and antifungal agents, for example, paraben, chlorobutanol, phenol sorbic acid, and the like. Isotonic agents, such as sugars, sodium chloride, and the like into the compositions, may also be desirable. In addition, prolonged absorption of the injectable pharmaceutical form may be brought about by the inclusion of agents which delay absorption such as, aluminum monostearate and gelatin.

Exemplary pharmaceutically acceptable carriers include sterile aqueous solutions or dispersions and sterile powders for the extemporaneous preparation of sterile injectable solutions or dispersion. Such media and reagents for pharmaceutically active substances are known in the art. The pharmaceutical compositions of the invention may include any conventional media or agent unless any is incompatible with the active molecular target antagonist compound. Supplementary active compounds may further be incorporated into the compositions.

Therapeutic compositions are typically sterile and stable under the conditions of manufacture and storage. The composition may be formulated as a solution, microemulsion, liposome, or other ordered structure suitable to high drug concentration. The carrier may be a solvent or dispersion medium containing, for example, water, alcohol such as ethanol, polyol (e.g., glycerol, propylene glycol, and liquid polyethylene glycol), or any suitable mixtures. The proper fluidity may be maintained, for example, by the use of a coating such as lecithin, by the maintenance of the required particle size in the case of dispersion and by use of surfactants according to formulation chemistry well known in the art. In certain embodiments, isotonic agents, e.g., sugars, polyalcohols such as mannitol, sorbitol, or sodium chloride may be desirable in the composition. Prolonged absorption of injectable compositions may be brought about by including in the composition an agent that delays absorption for example, monostearate salts and gelatin.

Solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and tonicity adjusting agents such as, e.g., sodium chloride or dextrose. The pH can be adjusted with acids or bases, such as hydrochloric acid or sodium hydroxide, or buffers with citrate, phosphate, acetate and the like. Such preparations may be enclosed in ampoules, disposable syringes or multiple dose vials made of glass or plastic.

Sterile injectable solutions may be prepared by incorporating a molecular target specific binding moiety (or MTRC or MTAC comprising such a moiety) in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof.

When a therapeutically effective amount of a molecular target antagonist compound of the invention is administered by, e.g., intravenous, cutaneous or subcutaneous injection, the binding agent will be in the form of a pyrogen-free, parenterally acceptable aqueous solution. Methods for preparing parenterally acceptable protein solutions, taking into consideration appropriate pH, isotonicity, stability, and the like, are within the skill in the art. A preferred pharmaceutical composition for intravenous, cutaneous, or subcutaneous injection will contain, in addition to binding agents, an isotonic vehicle such as sodium chloride injection, Ringer's injection, dextrose injection, dextrose and sodium chloride injection, lactated Ringer's injection, or other vehicle as known in the art. A pharmaceutical composition of the present invention may also contain stabilizers, preservatives, buffers, antioxidants, or other additives well known to those of skill in the art.

The amount of active ingredient which can be combined with a carrier material to produce a single dosage form will vary depending on a variety of factors, including the subject being treated, and the particular mode of administration. In general, it will be an amount of the composition that produces an appropriate therapeutic effect under the particular circumstances. Generally, out of one hundred percent, this amount will range from about 0.01 percent to about ninety-nine percent of active ingredient, from about 0.1 percent to about 70 percent, or from about 1 percent to about 30 percent of active ingredient in combination with a pharmaceutically acceptable carrier.

Dosage regimens may be adjusted to provide the optimum desired response (e.g., a therapeutic response). For example, a single bolus may be administered, several divided doses may be administered over time, or the dose may be proportionally reduced or increased as indicated by the particular circumstances of the therapeutic situation, on a case by case basis. It is especially advantageous to formulate parenteral compositions in dosage unit forms for ease of administration and uniformity of dosage when administered to the subject or patient. As used herein, a dosage unit form refers to physically discrete units suitable as unitary dosages for the subjects to be treated; each unit containing a predetermined quantity of active compound calculated to produce a desired therapeutic effect in association with the required pharmaceutical carrier. The specification for the dosage unit forms of the invention depend on the specific characteristics of the active compound and the particular therapeutic effect(s) to be achieved, taking into consideration and the treatment and sensitivity of any individual patient.

For administration of a molecular target regulatory (MTRC) e.g., antagonist compound (MTAC), the dosage range will generally be from about 0.0001 to 100 mg/kg, and more usually 0.01 to 5 mg/kg, of the host body weight. Exemplary dosages may be 0.25 mg/kg body weight, 1 mg/kg body weight, 3 mg/kg body weight, 5 mg/kg body weight or 10 mg/kg body weight or within the range of 1-10 mg/kg. An exemplary treatment regime is a once or twice daily administration, or a once or twice weekly administration, once every two weeks, once every three weeks, once every four weeks, once a month, once every two or three months or once every three to 6 months. Dosages may be selected and readjusted by the skilled health care professional as required to maximize therapeutic benefit for a particular subject, e.g., patient. Molecular target antagonist compounds will typically be administered on multiple occasions. Intervals between single dosages can be, for example, 2-5 days, weekly, monthly, every two or three months, every six months, or yearly. Intervals between administrations can also be irregular, based on regulating blood levels of molecular target antagonist to the molecular target in the subject or patient. In some methods, dosage is adjusted to achieve a plasma antagonist concentration of about 1-1000 µg/ml and in some methods about 25-300 µg/ml. Dosage regimens for a MTRC or MTAC of the invention include intravenous administration of 1 mg/kg body weight or 3 mg/kg body weight with the compound administered every two to four weeks for six dosages, then every three months at 3 mg/kg body weight or 1 mg/kg body weight.

In certain embodiments, two or more MTRCs or MTACs with different binding properties may be administered simultaneously or sequentially, in which case the dosage of each administered antagonist may be adjusted to fall within the ranges described herein.

In certain embodiments, a molecular target regulatory (MTRC) e.g., antagonist compound (MTAC) of the invention may be administered as a sustained release formulation, in which case less frequent administration is required. Dosage and frequency vary depending on the half-life of the MTRC or MTAC in the subject or patient. The dosage and frequency of administration may vary depending on whether the treatment is therapeutic or prophylactic (e.g., preventative), and may be adjusted during the course of treatment. In certain prophylactic applications, a relatively low dosage is administered at relatively infrequent intervals over a relatively long period of time. Some subjects may continue to receive treatment over their lifetime. In certain therapeutic applications, a relatively high dosage at relatively short intervals is sometimes required until progression of the disease is reduced or until the patient shows partial or complete amelioration of symptoms of disease. Thereafter, the patient may be switched to a suitable prophylactic dosing regimen.

Actual dosage levels of the MTRC or MTAC alone or in combination with one or more other active ingredients in the pharmaceutical compositions of the present invention may be varied so as to obtain an amount of the active ingredient which is effective to achieve the desired therapeutic response for a particular patient, composition, and mode of administration, without causing deleterious side effects to the subject or patient. A selected dosage level will depend upon a variety of factors, such as pharmacokinetic factors, including the activity of the particular MTRC or MTAC or composition employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the subject or patient being treated, and similar factors well known in the medical arts.

Administration of a "therapeutically effective dosage" of a MTRC or MTAC of the invention may result in a decrease in severity of disease symptoms, an increase in frequency and duration of disease symptom-free periods, or a prevention of impairment or disability due to the disease affliction.

A MTRC or MTAC or composition of the present invention may be administered via one or more routes of administration, using one or more of a variety of methods known in the art. As will be appreciated by the skilled worker, the route and/or mode of administration will vary depending upon the desired results. Routes of administration for MTRCs or MTACs or compositions of the invention include, e.g., intravenous, intramuscular, intradermal, intraperitoneal, subcutaneous, spinal or other parenteral routes of administration, for example by injection or infusion. The phrase "parenteral administration" as used herein refers to modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrastemal injection and infusion.

In other embodiments, a molecular target regulatory (MTRC) e.g, antagonist compound (MTAC) or composition of the invention may be administered by a non-parenteral route, such as a topical, epidermal or mucosal route of administration, for example, intranasally, orally, vaginally, rectally, sublingually or topically.

As described elsewhere herein, an active MTRC or MTAC may be prepared with carriers that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

Therapeutic compounds or compositions of the invention may be administered with one or more of a variety of medical devices known in the art. For example, in one embodiment, a therapeutic MTRC or MTAC of the invention may be administered with a needleless hypodermic injection device. Examples of well-known implants and modules useful in the present invention are in the art, including e.g., implantable micro-infusion pumps for controlled rate delivery; devices for administering through the skin; infusion pumps for delivery at a precise infusion rate; variable flow implantable infusion devices for continuous drug delivery; and osmotic drug delivery systems. These and other such implants, delivery systems, and modules are known to those skilled in the art.

In certain embodiments, the MTRC or MTAC or composition of the invention may be formulated to ensure a desired distribution in vivo. For example, the blood-brain barrier (BBB) excludes many highly hydrophilic compounds. To target a therapeutic compound or composition of the invention to a particular in vivo location, they can be formulated, for example, in liposomes which may comprise one or more moieties that are selectively transported into specific cells or organs, thus enhancing targeted drug delivery. Exemplary targeting moieties include folate or biotin; mannosides; antibodies; surfactant protein A receptor; p120 and the like.

K. Delivery Devices and Kits

In certain embodiments, the invention relates to a device comprising one or more molecular target regulatory (MTRC) e.g., antagonist compounds (MTACs) of the invention, or pharmaceutically acceptable salts or solvates thereof, for delivery to a subject. Thus, one or more compounds of the invention or pharmaceutically acceptable salts or solvates thereof can be administered to a patient in accordance with the present invention via a variety of delivery methods, including: intravenous, subcutaneous, intramuscular or intraperitoneal injection; oral administration; transdermal administration; pulmonary or transmucosal administration; administration by implant, osmotic pump, cartridge or micro pump; or by other means recognized by a person of skill in the art.

In some embodiments, the invention relates to a kit comprising one or more peptides, or pharmaceutically acceptable salts or solvates thereof, of the invention. In other embodiments, the kit comprises one or more pharmaceutical compositions comprising one or more peptides or pharmaceutically acceptable salts or solvates thereof. In certain embodiments, the kit further comprises packaging and/or instructions for use.

EXAMPLES

The following examples demonstrate certain embodiments of the present invention. However, it is to be understood that these examples are for illustration purposes only and do not intend, nor should any be construed, to be wholly definitive as to conditions and scope of this invention. The examples were carried out using standard techniques, which are well known and routine to those of skill in the art, except where otherwise described in detail.

Example 1. Bioinformatic Analyses of a Nurse Shark VNAR Type 2 Sequence Collection To generate a sequence database from which information could be extracted to build a semi-synthetic nurse shark VNAR library, blood samples from two adult nurse sharks were collected and VNAR cDNAs were amplified from peripheral blood leukocytes (PBL) essentially as previously described (Müller et al., 2012). Briefly, RNA was extracted from nurse shark buffy coat samples using RiboPure-Blood kit (Ambion). First strand cDNA synthesis was carried out for 60 minutes at 50° C., using SuperScript III Reverse Transcriptase (Invitrogen) and a 50:50 mixture of oligonucleotides 5'-TACAAATGTGGTGTACAGCAT-3' (SEQ ID NO: 62) and 5'-TAGTACGACCTGAAACATTAAC-3' (SEQ ID NO: 63). The second strand synthesis was performed for 27 cycles at 98° C. for 30 seconds and 72° C. for 1 minute, using Phusion 2× Mastermix (Thermo Scientific) with the forward oligonucleotide 5'-GAGGAGGAGGA-GAGGCCCAGGCGGCCGCTCGAGTGGAC-CAAACACCG-3' (SEQ ID NO: 64) and a 50:50 mixture of the reverse oligonucleotides 5'-GAGGAGGAGGAGGAG-GCCCCTGA GGCCGCATTCACAGTCACGACAGTGC-CACCTC-3' (SEQ ID NO: 65) and 5'-GAGGAGGAG-GAGG AGGCCCCTGAGGCCGCATTCACAGTCACGGCAGT-GCCATCTC-3' (SEQ ID NO: 66). The resulting PCR product was SfiI-digested and ligated into the pOsD2 vector. The ligation reaction was then transformed into hypercompetent TG1 E. coli cells and the VNAR insert of randomly-selected single colonies was sequenced by the Sanger chain termination method (GATC Biotech), using the specific oligonucleotide 5'-TCATTAGGCACCCCAGGCTTTACAC-3' (SEQ ID NO: 67). Sequences were aligned using the BioEdit® Software and the amino acid frequencies were determined using Microsoft Excel formulae.

Figure 1B4:
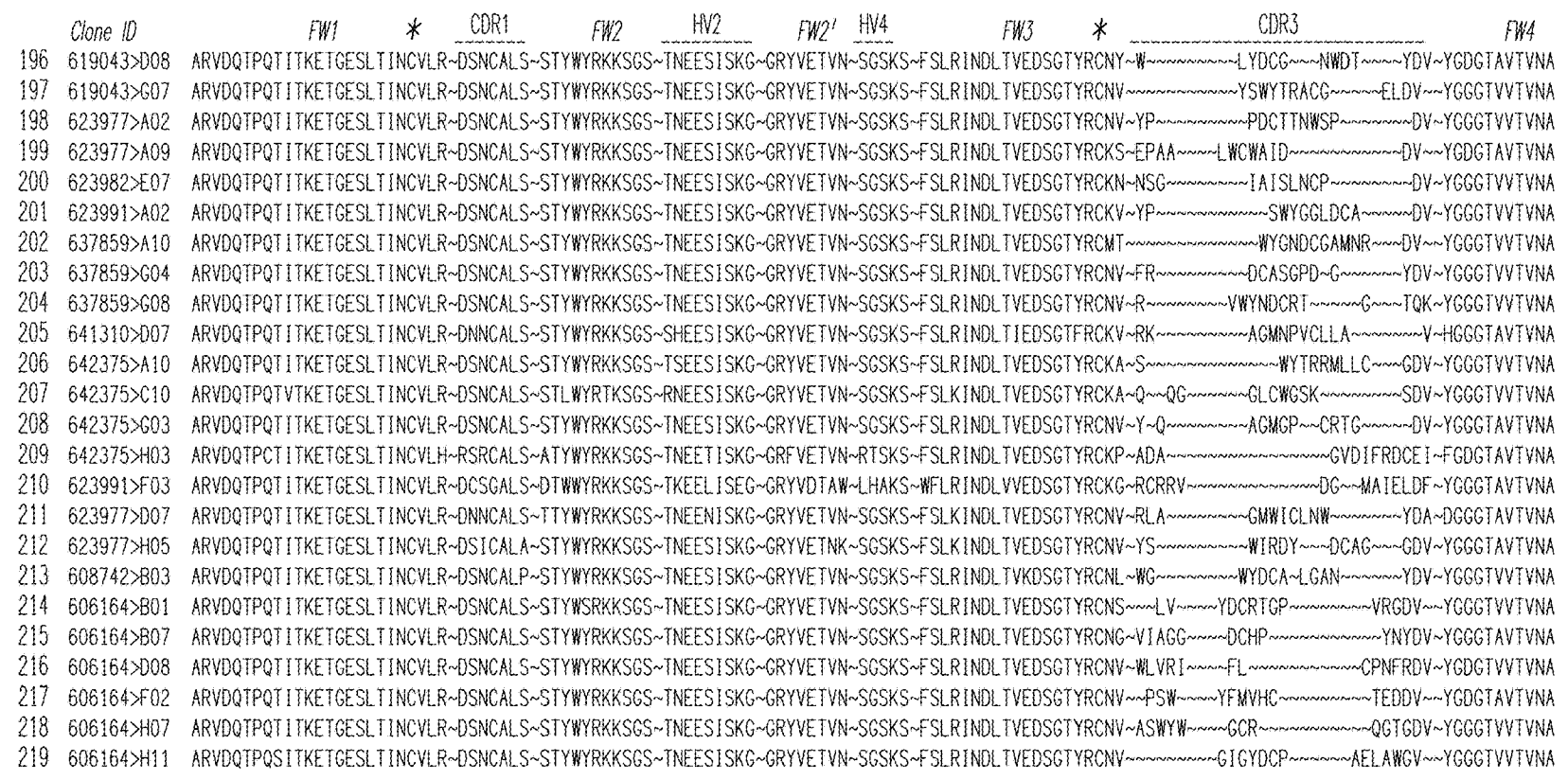

Randomly selected clones were sequenced and a total of 188 Type 2 VNAR sequences containing a single Cysteine (C) residue in their CDR3 region were collected. The protein amino acid sequences of these 188 VNARs were aligned in order to analyze sequence conservation in both the framework (FW) and CDR3 regions (FIG. 1). The amino acid composition data by position is shown for the 188 Type 2 VNARs in Table 1 below, where amino acid positions 1-25 are the FW1 region; positions 26-32 are CDR1; positions 33-43 are FW2; positions 44-52 are HV2; positions 53-60 are FW2'; positions 61-65 are HV4; positions 86-91 represent the variable length CDR3 region; and positions and 92-102 are FW4.

TABLE 1

| POSITION | A | R | N | D | C | Q | E | G | H | I |
|---|---|---|---|---|---|---|---|---|---|---|
| 1 | 100.00 | 0.00 | 0.00 | 0.00 | 0.00 | 0.00 | 0.00 | 0.00 | 0.00 | 0.00 |
| 2 | 0.00 | 100.00 | 0.00 | 0.00 | 0.00 | 0.00 | 0.00 | 0.00 | 0.00 | 0.00 |
| 3 | 0.00 | 0.00 | 0.00 | 0.00 | 0.00 | 0.00 | 0.00 | 0.00 | 0.00 | 0.00 |
| 4 | 0.00 | 0.00 | 0.00 | 100.00 | 0.00 | 0.00 | 0.00 | 0.00 | 0.00 | 0.00 |
| 5 | 0.00 | 0.00 | 0.00 | 0.00 | 0.00 | 100.00 | 0.00 | 0.00 | 0.00 | 0.00 |
| 6 | 0.00 | 0.00 | 0.00 | 0.00 | 0.00 | 0.00 | 0.00 | 0.00 | 0.00 | 0.00 |
| 7 | 0.00 | 0.00 | 0.00 | 0.00 | 0.00 | 0.00 | 0.00 | 0.00 | 0.00 | 0.00 |
| 8 | 0.00 | 2.13 | 0.00 | 0.00 | 0.53 | 97.34 | 0.00 | 0.00 | 0.00 | 0.00 |
| 9 | 0.00 | 0.00 | 0.00 | 0.00 | 0.00 | 0.00 | 0.00 | 0.00 | 0.00 | 0.00 |
| 10 | 0.00 | 0.00 | 0.00 | 0.00 | 0.00 | 0.00 | 0.00 | 0.00 | 0.00 | 96.81 |
| 11 | 0.00 | 0.00 | 0.00 | 0.00 | 0.00 | 0.00 | 0.00 | 0.00 | 0.00 | 0.00 |
| 12 | 0.00 | 0.53 | 0.00 | 0.00 | 0.00 | 0.00 | 0.00 | 0.00 | 0.00 | 0.00 |
| 13 | 0.00 | 0.00 | 0.00 | 0.00 | 0.00 | 0.00 | 99.47 | 0.00 | 0.00 | 0.00 |
| 14 | 0.00 | 0.00 | 0.00 | 0.00 | 0.00 | 0.00 | 0.00 | 0.00 | 0.00 | 0.00 |
| 15 | 0.00 | 0.00 | 0.00 | 0.00 | 0.00 | 0.00 | 0.00 | 100.00 | 0.00 | 0.00 |
| 16 | 0.00 | 0.00 | 0.00 | 0.00 | 0.00 | 0.00 | 100.00 | 0.00 | 0.00 | 0.00 |
| 17 | 0.00 | 0.00 | 0.00 | 0.00 | 0.00 | 0.00 | 0.00 | 0.00 | 0.00 | 0.00 |
| 18 | 0.00 | 0.00 | 0.00 | 0.00 | 0.00 | 0.00 | 0.00 | 0.00 | 0.00 | 0.00 |
| 19 | 0.00 | 0.00 | 0.00 | 0.00 | 0.00 | 0.00 | 0.00 | 0.00 | 0.00 | 0.00 |
| 20 | 0.00 | 0.00 | 0.00 | 0.00 | 0.00 | 0.00 | 0.00 | 0.00 | 0.00 | 100.00 |
| 21 | 0.00 | 0.00 | 99.47 | 0.00 | 0.00 | 0.00 | 0.00 | 0.00 | 0.00 | 0.00 |
| 22 | 0.00 | 0.00 | 0.00 | 0.00 | 100.00 | 0.00 | 0.00 | 0.00 | 0.00 | 0.00 |
| 23 | 1.06 | 0.00 | 0.00 | 0.00 | 0.00 | 0.00 | 0.00 | 0.00 | 0.00 | 0.00 |
| 24 | 3.19 | 0.00 | 0.00 | 0.00 | 0.00 | 0.00 | 0.00 | 0.00 | 0.00 | 0.00 |
| 25 | 0.00 | 97.87 | 0.00 | 0.00 | 0.00 | 0.00 | 0.00 | 0.00 | 0.53 | 0.00 |
| 26 | 0.53 | 1.06 | 0.00 | 97.34 | 0.00 | 0.00 | 0.53 | 0.53 | 0.00 | 0.00 |
| 27 | 0.53 | 1.06 | 2.13 | 0.00 | 0.53 | 0.00 | 0.00 | 0.53 | 0.00 | 0.00 |
| 28 | 0.00 | 0.53 | 93.09 | 0.00 | 0.00 | 0.00 | 0.53 | 0.53 | 0.00 | 1.60 |
| 29 | 0.00 | 0.00 | 0.00 | 0.00 | 99.47 | 0.00 | 0.00 | 0.53 | 0.00 | 0.00 |
| 30 | 92.02 | 0.00 | 0.00 | 1.60 | 0.00 | 0.00 | 1.06 | 0.53 | 0.00 | 0.53 |
| 31 | 0.00 | 0.00 | 0.00 | 0.00 | 0.00 | 0.00 | 0.00 | 0.00 | 0.00 | 0.00 |
| 32 | 1.60 | 0.00 | 0.00 | 1.60 | 0.00 | 0.00 | 0.00 | 0.00 | 0.53 | 0.00 |
| 33 | 2.13 | 5.32 | 2.66 | 0.53 | 0.00 | 0.00 | 0.53 | 0.53 | 0.00 | 0.00 |
| 34 | 0.00 | 0.00 | 0.00 | 0.00 | 0.00 | 0.00 | 0.00 | 0.53 | 0.00 | 0.00 |
| 35 | 0.00 | 0.00 | 0.00 | 0.53 | 0.00 | 0.00 | 0.00 | 0.00 | 1.06 | 0.00 |
| 36 | 0.00 | 0.00 | 0.00 | 0.00 | 0.00 | 0.00 | 0.00 | 0.00 | 0.00 | 0.00 |
| 37 | 0.00 | 0.00 | 0.53 | 0.00 | 0.00 | 0.00 | 0.00 | 0.00 | 0.00 | 0.00 |
| 38 | 0.00 | 98.94 | 0.00 | 0.00 | 0.00 | 0.00 | 0.00 | 0.00 | 1.06 | 0.00 |
| 39 | 0.00 | 0.00 | 0.53 | 0.00 | 0.00 | 0.53 | 0.53 | 0.53 | 0.00 | 0.53 |
| 40 | 0.53 | 0.00 | 1.06 | 0.00 | 0.00 | 1.06 | 0.00 | 0.00 | 0.00 | 0.00 |
| 41 | 0.00 | 0.53 | 0.00 | 0.00 | 0.00 | 0.00 | 0.00 | 0.00 | 0.00 | 0.00 |
| 42 | 1.06 | 0.00 | 0.00 | 2.13 | 0.00 | 0.00 | 0.53 | 95.74 | 0.00 | 0.00 |
| 43 | 0.00 | 0.53 | 0.00 | 0.00 | 0.00 | 0.00 | 0.00 | 0.00 | 0.00 | 0.00 |
| 44 | 0.00 | 2.66 | 0.00 | 0.00 | 0.00 | 0.00 | 0.00 | 0.00 | 0.00 | 0.53 |
| 45 | 0.00 | 0.00 | 95.74 | 1.60 | 0.00 | 0.00 | 0.00 | 0.00 | 0.53 | 0.00 |
| 46 | 0.00 | 0.00 | 0.00 | 0.00 | 0.00 | 0.53 | 97.87 | 0.00 | 0.00 | 0.00 |
| 47 | 0.53 | 0.00 | 0.00 | 1.06 | 0.00 | 0.00 | 96.81 | 0.53 | 0.00 | 0.00 |
| 48 | 0.00 | 1.60 | 4.79 | 0.53 | 0.00 | 0.00 | 0.53 | 0.00 | 0.53 | 0.53 |
| 49 | 0.00 | 0.00 | 0.00 | 0.00 | 0.00 | 0.00 | 0.00 | 0.00 | 0.00 | 98.94 |
| 50 | 0.00 | 0.00 | 0.00 | 0.53 | 0.00 | 0.00 | 0.00 | 0.00 | 0.00 | 0.00 |
| 51 | 0.00 | 0.00 | 0.00 | 0.00 | 0.00 | 0.00 | 0.53 | 0.00 | 0.00 | 1.06 |
| 52 | 0.00 | 0.00 | 0.00 | 0.53 | 0.00 | 0.00 | 0.00 | 97.87 | 0.00 | 0.00 |
| 53 | 0.00 | 0.00 | 0.00 | 0.00 | 0.00 | 0.00 | 0.00 | 100.00 | 0.00 | 0.00 |
| 54 | 0.00 | 100.00 | 0.00 | 0.00 | 0.00 | 0.00 | 0.00 | 0.00 | 0.00 | 0.00 |
| 55 | 0.00 | 0.00 | 0.00 | 0.00 | 0.00 | 0.00 | 0.00 | 0.00 | 0.00 | 0.00 |
| 56 | 0.00 | 0.00 | 0.00 | 0.00 | 0.00 | 0.00 | 0.00 | 0.00 | 0.00 | 1.60 |
| 57 | 0.00 | 0.00 | 0.00 | 0.53 | 0.00 | 0.00 | 99.47 | 0.00 | 0.00 | 0.00 |
| 58 | 0.00 | 0.00 | 0.00 | 0.00 | 0.00 | 0.00 | 0.00 | 0.00 | 0.00 | 1.06 |
| 59 | 1.06 | 0.00 | 0.53 | 0.00 | 0.00 | 0.00 | 0.00 | 0.00 | 0.00 | 0.00 |
| 60 | 0.00 | 0.53 | 97.34 | 0.00 | 0.00 | 0.00 | 0.00 | 0.00 | 0.00 | 0.00 |
| 61 | 0.00 | 2.66 | 0.53 | 0.00 | 0.00 | 0.00 | 0.00 | 0.00 | 0.00 | 0.00 |
| 62 | 0.00 | 0.53 | 0.00 | 0.53 | 0.00 | 0.00 | 1.06 | 96.28 | 0.53 | 0.00 |
| 63 | 1.60 | 0.53 | 0.00 | 0.00 | 0.00 | 0.00 | 0.53 | 0.00 | 0.00 | 0.00 |
| 64 | 0.00 | 0.00 | 0.00 | 0.00 | 0.00 | 0.53 | 0.00 | 0.00 | 0.00 | 0.00 |
| 65 | 0.00 | 0.53 | 0.00 | 0.00 | 0.00 | 0.00 | 0.00 | 0.00 | 0.00 | 0.00 |
| 66 | 0.00 | 0.00 | 0.00 | 0.00 | 0.00 | 0.00 | 0.00 | 0.00 | 0.53 | 0.00 |
| 67 | 0.00 | 0.00 | 0.00 | 0.00 | 0.00 | 0.53 | 0.00 | 0.00 | 0.53 | 0.00 |
| 68 | 0.00 | 0.00 | 0.00 | 0.00 | 0.00 | 0.00 | 0.00 | 0.00 | 0.00 | 0.00 |
| 69 | 0.00 | 97.87 | 0.53 | 0.00 | 0.00 | 0.00 | 0.00 | 0.00 | 0.00 | 0.00 |
| 70 | 0.00 | 0.00 | 0.00 | 0.00 | 0.00 | 0.00 | 0.00 | 0.00 | 0.00 | 100.00 |
| 71 | 0.00 | 0.00 | 98.40 | 0.00 | 0.00 | 0.00 | 0.00 | 0.00 | 0.00 | 0.00 |
| 72 | 0.00 | 0.00 | 0.00 | 100.00 | 0.00 | 0.00 | 0.00 | 0.00 | 0.00 | 0.00 |
| 73 | 0.00 | 0.00 | 0.00 | 0.00 | 0.00 | 0.00 | 0.00 | 0.00 | 0.00 | 0.00 |
| 74 | 0.00 | 1.60 | 0.00 | 0.00 | 0.00 | 0.00 | 0.00 | 0.00 | 0.00 | 1.60 |
| 75 | 0.00 | 0.00 | 0.00 | 0.00 | 0.00 | 0.00 | 0.00 | 0.00 | 0.00 | 1.06 |
| 76 | 0.00 | 0.53 | 0.00 | 0.00 | 0.00 | 0.00 | 97.34 | 1.06 | 0.00 | 0.00 |
| 77 | 0.00 | 0.00 | 0.00 | 100.00 | 0.00 | 0.00 | 0.00 | 0.00 | 0.00 | 0.00 |
| 78 | 0.53 | 0.00 | 1.06 | 0.00 | 0.00 | 0.00 | 0.00 | 1.06 | 0.00 | 0.00 |

TABLE 1-continued

| | | | | | | | | | | |
|---|---|---|---|---|---|---|---|---|---|---|
| 79 | 0.00 | 0.00 | 0.00 | 0.00 | 0.00 | 0.00 | 0.00 | 100.00 | 0.00 | 0.00 |
| 80 | 1.06 | 0.00 | 0.53 | 0.00 | 0.00 | 0.00 | 0.00 | 0.00 | 0.00 | 0.00 |
| 81 | 0.00 | 0.00 | 0.00 | 0.00 | 0.00 | 0.00 | 0.00 | 0.00 | 0.00 | 0.00 |
| 82 | 0.00 | 98.40 | 0.00 | 0.00 | 0.00 | 0.00 | 0.00 | 1.06 | 0.53 | 0.00 |
| 83 | 0.00 | 0.00 | 0.00 | 0.00 | 100.00 | 0.00 | 0.00 | 0.00 | 0.00 | 0.00 |
| 84 | 0.00 | 1.06 | 53.19 | 0.00 | 0.00 | 1.06 | 0.00 | 1.06 | 0.00 | 0.00 |
| 85 | 10.64 | 0.00 | 0.53 | 0.00 | 0.53 | 0.00 | 1.06 | 5.85 | 0.00 | 1.06 |
| 86 | 0.00 | 0.00 | 0.00 | 0.00 | 0.00 | 0.00 | 0.00 | 0.00 | 0.00 | 0.00 |
| 87 | 0.00 | 0.00 | 0.00 | 0.00 | 0.00 | 0.00 | 0.00 | 0.00 | 0.00 | 0.00 |
| 88 | 0.00 | 0.00 | 0.00 | 0.00 | 0.00 | 0.00 | 0.00 | 0.00 | 0.00 | 0.00 |
| 89 | 0.00 | 0.00 | 0.00 | 0.00 | 0.00 | 0.00 | 0.00 | 0.00 | 0.00 | 0.00 |
| 90 | 0.00 | 0.00 | 0.00 | 0.00 | 0.00 | 0.00 | 0.00 | 0.00 | 0.00 | 0.00 |
| 91 | 0.00 | 0.00 | 0.00 | 0.00 | 0.00 | 0.00 | 0.00 | 0.00 | 0.00 | 0.00 |
| 92 | 0.53 | 0.53 | 1.60 | 1.06 | 0.00 | 0.00 | 0.00 | 0.53 | 1.06 | 0.00 |
| 93 | 0.00 | 0.00 | 0.00 | 0.00 | 0.00 | 0.00 | 0.00 | 100.00 | 0.00 | 0.00 |
| 94 | 0.00 | 0.00 | 0.00 | 20.74 | 0.00 | 0.00 | 0.00 | 79.26 | 0.00 | 0.00 |
| 95 | 0.00 | 0.00 | 0.00 | 0.00 | 0.00 | 0.00 | 0.00 | 100.00 | 0.00 | 0.00 |
| 96 | 0.00 | 0.00 | 0.00 | 0.00 | 0.00 | 0.00 | 0.00 | 0.00 | 0.00 | 0.00 |
| 97 | 48.94 | 0.00 | 0.00 | 0.00 | 0.00 | 0.00 | 0.00 | 0.00 | 0.00 | 0.00 |
| 98 | 0.00 | 0.00 | 0.00 | 0.00 | 0.00 | 0.00 | 0.00 | 0.00 | 0.00 | 0.00 |
| 99 | 0.00 | 0.00 | 0.00 | 0.00 | 0.00 | 0.00 | 0.00 | 0.00 | 0.00 | 0.00 |
| 100 | 0.00 | 0.00 | 0.00 | 0.00 | 0.00 | 0.00 | 0.00 | 0.00 | 0.00 | 0.00 |
| 101 | 0.00 | 0.00 | 100.00 | 0.00 | 0.00 | 0.00 | 0.00 | 0.00 | 0.00 | 0.00 |
| 102 | 100.00 | 0.00 | 0.00 | 0.00 | 0.00 | 0.00 | 0.00 | 0.00 | 0.00 | 0.00 |

| POSITION | L | K | M | F | P | S | T | W | Y | V |
|---|---|---|---|---|---|---|---|---|---|---|
| 1 | 0.00 | 0.00 | 0.00 | 0.00 | 0.00 | 0.00 | 0.00 | 0.00 | 0.00 | 0.00 |
| 2 | 0.00 | 0.00 | 0.00 | 0.00 | 0.00 | 0.00 | 0.00 | 0.00 | 0.00 | 0.00 |
| 3 | 0.00 | 0.00 | 0.00 | 0.00 | 0.00 | 0.00 | 0.00 | 0.00 | 0.00 | 100.00 |
| 4 | 0.00 | 0.00 | 0.00 | 0.00 | 0.00 | 0.00 | 0.00 | 0.00 | 0.00 | 0.00 |
| 5 | 0.00 | 0.00 | 0.00 | 0.00 | 0.00 | 0.00 | 0.00 | 0.00 | 0.00 | 0.00 |
| 6 | 0.00 | 0.53 | 0.00 | 0.00 | 0.00 | 0.00 | 99.47 | 0.00 | 0.00 | 0.00 |
| 7 | 0.00 | 0.00 | 0.00 | 0.00 | 100.00 | 0.00 | 0.00 | 0.00 | 0.00 | 0.00 |
| 8 | 0.00 | 0.00 | 0.00 | 0.00 | 0.00 | 0.00 | 0.00 | 0.00 | 0.00 | 0.00 |
| 9 | 0.00 | 0.00 | 0.00 | 0.00 | 0.00 | 2.66 | 97.34 | 0.00 | 0.00 | 0.00 |
| 10 | 0.53 | 0.00 | 0.53 | 0.00 | 0.00 | 0.00 | 0.00 | 0.00 | 0.00 | 2.13 |
| 11 | 0.00 | 0.00 | 0.00 | 0.00 | 0.00 | 0.53 | 99.47 | 0.00 | 0.00 | 0.00 |
| 12 | 0.00 | 99.47 | 0.00 | 0.00 | 0.00 | 0.00 | 0.00 | 0.00 | 0.00 | 0.00 |
| 13 | 0.00 | 0.00 | 0.00 | 0.00 | 0.00 | 0.00 | 0.00 | 0.00 | 0.00 | 0.53 |
| 14 | 0.00 | 0.53 | 0.00 | 0.00 | 0.00 | 0.00 | 99.47 | 0.00 | 0.00 | 0.00 |
| 15 | 0.00 | 0.00 | 0.00 | 0.00 | 0.00 | 0.00 | 0.00 | 0.00 | 0.00 | 0.00 |
| 16 | 0.00 | 0.00 | 0.00 | 0.00 | 0.00 | 0.00 | 0.00 | 0.00 | 0.00 | 0.00 |
| 17 | 0.00 | 0.00 | 0.00 | 0.00 | 0.00 | 100.00 | 0.00 | 0.00 | 0.00 | 0.00 |
| 18 | 99.47 | 0.00 | 0.00 | 0.00 | 0.00 | 0.00 | 0.00 | 0.00 | 0.00 | 0.53 |
| 19 | 0.00 | 0.00 | 0.00 | 0.00 | 0.00 | 0.00 | 100.00 | 0.00 | 0.00 | 0.00 |
| 20 | 0.00 | 0.00 | 0.00 | 0.00 | 0.00 | 0.00 | 0.00 | 0.00 | 0.00 | 0.00 |
| 21 | 0.00 | 0.53 | 0.00 | 0.00 | 0.00 | 0.00 | 0.00 | 0.00 | 0.00 | 0.00 |
| 22 | 0.00 | 0.00 | 0.00 | 0.00 | 0.00 | 0.00 | 0.00 | 0.00 | 0.00 | 0.00 |
| 23 | 0.53 | 0.00 | 0.00 | 0.00 | 0.00 | 0.00 | 0.00 | 0.00 | 0.00 | 98.40 |
| 24 | 96.28 | 0.00 | 0.00 | 0.00 | 0.00 | 0.00 | 0.00 | 0.00 | 0.00 | 0.53 |
| 25 | 1.06 | 0.00 | 0.00 | 0.00 | 0.00 | 0.53 | 0.00 | 0.00 | 0.00 | 0.00 |
| 26 | 0.00 | 0.00 | 0.00 | 0.00 | 0.00 | 0.00 | 0.00 | 0.00 | 0.00 | 0.00 |
| 27 | 0.00 | 0.00 | 0.00 | 0.00 | 0.00 | 93.62 | 1.60 | 0.00 | 0.00 | 0.00 |
| 28 | 0.00 | 0.53 | 0.00 | 0.00 | 0.53 | 1.06 | 1.06 | 0.00 | 0.00 | 0.53 |
| 29 | 0.00 | 0.00 | 0.00 | 0.00 | 0.00 | 0.00 | 0.00 | 0.00 | 0.00 | 0.00 |
| 30 | 0.00 | 0.00 | 0.00 | 0.00 | 2.13 | 0.00 | 0.53 | 0.00 | 0.53 | 1.06 |
| 31 | 96.81 | 0.00 | 0.53 | 1.06 | 0.00 | 0.00 | 0.00 | 0.53 | 0.00 | 1.06 |
| 32 | 0.53 | 0.00 | 0.00 | 0.00 | 1.06 | 92.55 | 1.06 | 0.00 | 0.53 | 0.53 |
| 33 | 0.00 | 1.06 | 0.00 | 0.00 | 0.00 | 85.64 | 0.53 | 0.53 | 0.53 | 0.53 |
| 34 | 0.53 | 0.00 | 0.00 | 0.00 | 0.00 | 0.00 | 98.94 | 0.00 | 0.00 | 0.00 |
| 35 | 1.06 | 0.00 | 0.00 | 0.53 | 0.00 | 1.60 | 0.00 | 1.06 | 94.15 | 0.00 |
| 36 | 0.00 | 0.00 | 0.00 | 0.53 | 0.00 | 0.00 | 0.00 | 99.47 | 0.00 | 0.00 |
| 37 | 1.60 | 0.00 | 0.00 | 0.53 | 0.00 | 1.60 | 0.00 | 0.00 | 95.74 | 0.00 |
| 38 | 0.00 | 0.00 | 0.00 | 0.00 | 0.00 | 0.00 | 0.00 | 0.00 | 0.00 | 0.00 |
| 39 | 0.00 | 94.15 | 0.00 | 0.00 | 0.00 | 1.06 | 2.13 | 0.00 | 0.00 | 0.00 |
| 40 | 0.53 | 96.28 | 0.00 | 0.00 | 0.00 | 0.53 | 0.00 | 0.00 | 0.00 | 0.00 |
| 41 | 0.00 | 0.53 | 0.00 | 0.00 | 0.00 | 97.87 | 1.06 | 0.00 | 0.00 | 0.00 |
| 42 | 0.00 | 0.00 | 0.00 | 0.00 | 0.00 | 0.53 | 0.00 | 0.00 | 0.00 | 0.00 |
| 43 | 0.00 | 0.00 | 0.00 | 0.00 | 0.00 | 98.94 | 0.00 | 0.00 | 0.53 | 0.00 |
| 44 | 0.00 | 0.00 | 0.00 | 0.00 | 0.00 | 1.06 | 95.74 | 0.00 | 0.00 | 0.00 |
| 45 | 0.00 | 0.53 | 0.00 | 0.00 | 0.53 | 1.06 | 0.00 | 0.00 | 0.00 | 0.00 |
| 46 | 0.00 | 0.00 | 0.00 | 0.00 | 0.00 | 0.00 | 0.53 | 1.06 | 0.00 | 0.00 |
| 47 | 0.00 | 0.53 | 0.00 | 0.00 | 0.00 | 0.00 | 0.00 | 0.00 | 0.00 | 0.53 |
| 48 | 1.06 | 0.00 | 0.00 | 0.00 | 0.00 | 87.23 | 3.19 | 0.00 | 0.00 | 0.00 |
| 49 | 0.00 | 0.00 | 0.00 | 0.00 | 0.00 | 0.00 | 0.00 | 0.00 | 0.00 | 1.06 |
| 50 | 1.06 | 0.53 | 0.00 | 0.00 | 0.00 | 96.81 | 0.53 | 0.53 | 0.00 | 0.00 |
| 51 | 1.60 | 95.74 | 0.00 | 0.00 | 0.53 | 0.00 | 0.53 | 0.00 | 0.00 | 0.00 |
| 52 | 0.00 | 0.00 | 0.00 | 0.00 | 0.00 | 1.06 | 0.53 | 0.00 | 0.00 | 0.00 |
| 53 | 0.00 | 0.00 | 0.00 | 0.00 | 0.00 | 0.00 | 0.00 | 0.00 | 0.00 | 0.00 |

TABLE 1-continued

| | | | | | | | | | | |
|---|---|---|---|---|---|---|---|---|---|---|
| 54 | 0.00 | 0.00 | 0.00 | 0.00 | 0.00 | 0.00 | 0.00 | 0.00 | 0.00 | 0.00 |
| 55 | 0.00 | 0.00 | 0.00 | 0.53 | 0.00 | 0.00 | 0.00 | 0.00 | 99.47 | 0.00 |
| 56 | 0.00 | 0.00 | 0.00 | 0.53 | 0.00 | 0.53 | 0.00 | 0.00 | 0.00 | 96.81 |
| 57 | 0.00 | 0.00 | 0.00 | 0.00 | 0.00 | 0.00 | 0.00 | 0.00 | 0.00 | 0.00 |
| 58 | 0.00 | 0.00 | 0.00 | 0.00 | 0.00 | 0.00 | 98.94 | 0.00 | 0.00 | 0.00 |
| 59 | 0.00 | 0.00 | 0.00 | 0.53 | 0.00 | 0.53 | 0.00 | 0.00 | 0.00 | 97.34 |
| 60 | 0.00 | 1.60 | 0.00 | 0.00 | 0.00 | 0.00 | 0.00 | 0.53 | 0.00 | 0.00 |
| 61 | 0.53 | 0.00 | 0.00 | 0.00 | 0.00 | 95.21 | 1.06 | 0.00 | 0.00 | 0.00 |
| 62 | 0.53 | 0.00 | 0.00 | 0.00 | 0.00 | 0.00 | 0.53 | 0.00 | 0.00 | 0.00 |
| 63 | 0.00 | 0.00 | 0.00 | 0.00 | 0.00 | 97.34 | 0.00 | 0.00 | 0.00 | 0.00 |
| 64 | 0.00 | 99.47 | 0.00 | 0.00 | 0.00 | 0.00 | 0.00 | 0.00 | 0.00 | 0.00 |
| 65 | 0.00 | 0.00 | 0.00 | 0.53 | 0.00 | 98.40 | 0.00 | 0.00 | 0.53 | 0.00 |
| 66 | 1.60 | 0.00 | 0.00 | 95.74 | 0.00 | 1.60 | 0.00 | 0.53 | 0.00 | 0.00 |
| 67 | 0.00 | 0.00 | 0.00 | 1.06 | 0.00 | 97.87 | 0.00 | 0.00 | 0.00 | 0.00 |
| 68 | 100.00 | 0.00 | 0.00 | 0.00 | 0.00 | 0.00 | 0.00 | 0.00 | 0.00 | 0.00 |
| 69 | 0.00 | 1.60 | 0.00 | 0.00 | 0.00 | 0.00 | 0.00 | 0.00 | 0.00 | 0.00 |
| 70 | 0.00 | 0.00 | 0.00 | 0.00 | 0.00 | 0.00 | 0.00 | 0.00 | 0.00 | 0.00 |
| 71 | 0.00 | 0.00 | 0.00 | 0.00 | 0.00 | 0.00 | 0.53 | 0.00 | 1.06 | 0.00 |
| 72 | 0.00 | 0.00 | 0.00 | 0.00 | 0.00 | 0.00 | 0.00 | 0.00 | 0.00 | 0.00 |
| 73 | 99.47 | 0.00 | 0.00 | 0.00 | 0.00 | 0.00 | 0.00 | 0.00 | 0.00 | 0.53 |
| 74 | 0.00 | 0.00 | 0.00 | 0.00 | 0.00 | 0.53 | 94.68 | 0.00 | 0.00 | 1.60 |
| 75 | 0.53 | 0.00 | 0.00 | 0.00 | 0.00 | 0.53 | 0.00 | 0.00 | 0.00 | 97.87 |
| 76 | 0.53 | 0.53 | 0.00 | 0.00 | 0.00 | 0.00 | 0.00 | 0.00 | 0.00 | 0.00 |
| 77 | 0.00 | 0.00 | 0.00 | 0.00 | 0.00 | 0.00 | 0.00 | 0.00 | 0.00 | 0.00 |
| 78 | 0.00 | 0.00 | 0.00 | 0.00 | 0.00 | 97.34 | 0.00 | 0.00 | 0.00 | 0.00 |
| 79 | 0.00 | 0.00 | 0.00 | 0.00 | 0.00 | 0.00 | 0.00 | 0.00 | 0.00 | 0.00 |
| 80 | 0.00 | 0.00 | 0.00 | 0.00 | 0.00 | 0.53 | 97.87 | 0.00 | 0.00 | 0.00 |
| 81 | 1.60 | 0.00 | 0.00 | 0.53 | 0.00 | 0.00 | 0.00 | 0.53 | 97.34 | 0.00 |
| 82 | 0.00 | 0.00 | 0.00 | 0.00 | 0.00 | 0.00 | 0.00 | 0.00 | 0.00 | 0.00 |
| 83 | 0.00 | 0.00 | 0.00 | 0.00 | 0.00 | 0.00 | 0.00 | 0.00 | 0.00 | 0.00 |
| 84 | 0.53 | 40.43 | 0.53 | 0.00 | 0.53 | 0.53 | 0.53 | 0.00 | 0.00 | 0.53 |
| 85 | 2.13 | 0.00 | 0.53 | 0.00 | 2.13 | 4.79 | 5.32 | 1.06 | 2.13 | 62.23 |
| 86 | 0.00 | 0.00 | 0.00 | 0.00 | 0.00 | 0.00 | 0.00 | 0.00 | 0.00 | 0.00 |
| 87 | 0.00 | 0.00 | 0.00 | 0.00 | 0.00 | 0.00 | 0.00 | 0.00 | 0.00 | 0.00 |
| 88 | 0.00 | 0.00 | 0.00 | 0.00 | 0.00 | 0.00 | 0.00 | 0.00 | 0.00 | 0.00 |
| 89 | 0.00 | 0.00 | 0.00 | 0.00 | 0.00 | 0.00 | 0.00 | 0.00 | 0.00 | 0.00 |
| 90 | 0.00 | 0.00 | 0.00 | 0.00 | 0.00 | 0.00 | 0.00 | 0.00 | 0.00 | 0.00 |
| 91 | 0.00 | 0.00 | 0.00 | 0.00 | 0.00 | 0.00 | 0.00 | 0.00 | 0.00 | 0.00 |
| 92 | 0.00 | 0.00 | 0.00 | 1.06 | 0.00 | 1.06 | 0.00 | 0.00 | 92.55 | 0.00 |
| 93 | 0.00 | 0.00 | 0.00 | 0.00 | 0.00 | 0.00 | 0.00 | 0.00 | 0.00 | 0.00 |
| 94 | 0.00 | 0.00 | 0.00 | 0.00 | 0.00 | 0.00 | 0.00 | 0.00 | 0.00 | 0.00 |
| 95 | 0.00 | 0.00 | 0.00 | 0.00 | 0.00 | 0.00 | 0.00 | 0.00 | 0.00 | 0.00 |
| 96 | 0.00 | 0.00 | 0.00 | 0.00 | 0.00 | 0.00 | 100.00 | 0.00 | 0.00 | 0.00 |
| 97 | 0.00 | 0.00 | 0.00 | 0.00 | 0.00 | 0.00 | 0.00 | 0.00 | 0.00 | 51.06 |
| 98 | 0.00 | 0.00 | 0.00 | 0.00 | 0.00 | 0.00 | 0.00 | 0.00 | 0.00 | 100.00 |
| 99 | 0.00 | 0.00 | 0.00 | 0.00 | 0.00 | 0.00 | 100.00 | 0.00 | 0.00 | 0.00 |
| 100 | 0.00 | 0.00 | 0.00 | 0.00 | 0.00 | 0.00 | 0.00 | 0.00 | 0.00 | 100.00 |
| 101 | 0.00 | 0.00 | 0.00 | 0.00 | 0.00 | 0.00 | 0.00 | 0.00 | 0.00 | 0.00 |
| 102 | 0.00 | 0.00 | 0.00 | 0.00 | 0.00 | 0.00 | 0.00 | 0.00 | 0.00 | 0.00 |

The number of amino acids in the CDR3 regions of each clone was measured and it was observed that more than 80% of the naturally occurring Type 2 CDR3s have a length ranging from 11 to 18 amino acids (FIG. 2). The amino acid composition at each position of the framework regions (excluding the CDR3) was then analysed (Table 1) in order to identify the most frequently found mutations in the framework regions.

This analysis revealed that most positions along the frameworks are highly conserved while fewer positions show a relatively high level of sequence variability. The main areas of variability were observed within CDR1 and HV2 regions (positions 26 to 52), and on both edges of CDR3 region, especially at positions 84, 94 and 97. Further analysis of the sequence variation at position 84 showed that the presence of an asparagine residue (N) at this position was preferred in front of relatively short CDR3s (less than 16 amino acids), while the presence of a lysine residue (K) at this position was preferred in front of longer CDR3s (16 amino acids or more) (FIG. 3A-B). A more detailed analysis was also performed on the other side of the CDR3, at positions 94 and 97. At each of these two positions, the sequence variability was limited (by the reverse oligonucleotides) to two different residues only. Position 94 harboured either a glycine (G) or an aspartate (D), while position 97 harboured either a valine (V) or an alanine (A) residue. Of the four possible permutations between these residues, only three were significantly represented in the set of sequences analysed (FIG. 3C).

The protein sequences of the 188 CDR3s (sorted into different categories based on their length) were subsequently aligned and the amino acid composition at each position was analysed as previously done for the framework regions. This analysis showed that, although the amino acid composition of this region is highly variable, the last two residues of the CDR3 regions in every size category are highly conserved as aspartate (D) followed by valine (V). The same analysis also identified the preferred position of the single cysteine residue in the CDR3. Results showed that, although the cysteine is not fixed at a specific position, it has some preferred positions in each CDR3 category, and is usually located near the centre of the loop (FIG. 4A-C).

Example 2. Design and Generation of a VNAR Type 2 Semi-Synthetic Library (OsX-3)

Information collected from analyses of the Type 2 database in Example 1 was included in a new semi-synthetic design of a VNAR Type 2 library incorporating amino acid sequence variation in both the CDR3 and the framework regions. Technically, the library was generated by an overlap PCR reaction, in which a first fragment (left arm) containing various framework mutations was hybridized with a second fragment (right arm) incorporating both CDR3 randomization and sequence variation on the CDR3 edges based on results from Example 1 (FIG. 5).

In order to introduce representative mutations in the framework regions, the most frequently observed amino acid substitutions were introduced in the library by using a mixture of ten selected VNAR templates. These molecules were selected in the Type 2 database based on two criteria. First, they all contain some of the most frequently observed framework mutations (mainly located in the CDR1 and HV2 regions) (FIG. 6A). Second, these templates also share 100% sequence identity at the DNA level over a 23 nucleotide stretch located just upstream of the CDR3 (FIG. 6B). This last feature enabled amplification of all templates together in the overlap PCR reaction.

The oligonucleotides used for generating the OsX-3 library are listed below in Table 2. The left arm, encompassing frameworks 1 to 3 and incorporating various framework mutations, was synthesized by PCR for 30 cycles at 98° C. (15 seconds), 62° C. (30 seconds), 72° C. (30 seconds), using Phusion 2× Mastermix (Thermo Scientific) with an equimolar mixture of the ten VNAR templates and oligonucleotides number 1 and 2 (Table 2). Formation of chimeric molecules between the different templates was encouraged by using relatively long extension times and a high number of PCR cycles to further increase the complexity of the library.

Amplification of a right arm fragment, encompassing the CDR3 and framework 4 regions, was synthesized by PCR as described for the left arm, with oligonucleotides number 3 and an equimolar mixture of 6 degenerate oligonucleotides specific for each CDR3 length. First, based on the size repartition of the CDR3s (FIG. 2), eight different CDR3 lengths were included in the semi-synthetic library (11mer, 12mer, 13mer, 14mer, 15mer, 16mer, 17mer, and 18mer) in order to cover most of the length variability observed in naturally occurring VNARs. For each of the eight chosen lengths, six different CDR3 architectures were designed (see below; see also FIG. 7 and Table 2).

The mixture for 11mer contained oligonucleotides 4, 5, 6, 7, 8, and 9.
The mixture for 12mer contained oligonucleotides 10, 11, 12, 13, 14, and 15.
The mixture for 13mer contained oligonucleotides 16, 17, 18, 19, 20, and 21.
The mixture for 14mer contained oligonucleotides 22, 23, 24, 25, 26, and 27.
The mixture for 15mer contained oligonucleotides 28, 29, 30, 31, 32, and 33.
The mixture for 16mer contained oligonucleotides 34, 35, 36, 37, 38, and 39.
The mixture for 17mer contained oligonucleotides 40, 41, 42, 43, 44, and 45.
The mixture for 18mer contained oligonucleotides 46, 47, 48, 49, 50, and 51.

TABLE 2

Oligonucleotides Used In This Study

| OLIGO-NUCLEOTIDE NUMBER | SEQ ID NO: | DNA SEQUENCE (5'-3') |
|---|---|---|
| 1 | 67 | TCATTAGGCACCCCAGGCTTTACAC |
| 2 | 68 | GCATCGATACGTGCCACTGTC |
| 3 | 69 | ATTAAAGCCAGAATGGAAAGCGCAG |
| 4 | 70 | GACAGTGGCACGTATCGATGCAACGTANNKNNKNNKNNKTGCNNKNNKNNKNNKGATGTATACGG AGGTGGCACTGTCGTGACTGTGAATGCGGCC |
| 5 | 71 | GACAGTGGCACGTATCGATGCAACGTANNKNNKNNKNNKTGCNNKNNKNNKNNKGATGTATACGG AGGTGGCACTGCCGTGACTGTGAATGCGGCC |
| 6 | 72 | GACAGTGGCACGTATCGATGCAACGTANNKNNKNNKNNKTGCNNKNNKNNKNNKGATGTATACGG AGATGGCACTGCCGTGACTGTGAATGCGGCC |
| 7 | 73 | GACAGTGGCACGTATCGATGCAACGTANNKNNKNNKDRYDRYDRYNNKNNKNNKGATGTATACGG AGGTGGCACTGTCGTGACTGTGAATGCGGCC |
| 8 | 74 | GACAGTGGCACGTATCGATGCAACGTANNKNNKNNKDRYDRYDRYNNKNNKNNKGATGTATACGG AGGTGGCACTGCCGTGACTGTGAATGCGGCC |
| 9 | 75 | GACAGTGGCACGTATCGATGCAACGTANNKNNKNNKDRYDRYDRYNNKNNKNNKGATGTATACGG AGATGGCACTGCCGTGACTGTGAATGCGGCC |
| 10 | 76 | GACAGTGGCACGTATCGATGCAACGTANNKNNKNNKNNKNNKTGCNNKNNKNNKNNKNNKGATGTATACGGAGGTGGCACTGTCGTGACTGTGAATGCGGCC |

TABLE 2-continued

Oligonucleotides Used In This Study

| OLIGO-NUCLEO-TIDE NUMBER | SEQ ID NO: | DNA SEQUENCE (5'-3') |
|---|---|---|
| 11 | 77 | GACAGTGGCACGTATCGATGCAACGTANNKNNKNNKNNKNNKTGCNNKNNKNNKNNKG<br>ATGTATACGGAGGTGGCACTGCCGTGACTGTGAATGCGGCC |
| 12 | 78 | GACAGTGGCACGTATCGATGCAACGTANNKNNKNNKNNKNNKTGCNNKNNKNNKNNKG<br>ATGTATACGGAGATGGCACTGCCGTGACTGTGAATGCGGCC |
| 13 | 79 | GACAGTGGCACGTATCGATGCAACGTANNKNNKNNKDRYDRYDRYNNKNNKNNKNNKG<br>ATGTATACGGAGGTGGCACTGTCGTGACTGTGAATGCGGCC |
| 14 | 80 | GACAGTGGCACGTATCGATGCAACGTANNKNNKNNKDRYDRYDRYNNKNNKNNKNNKG<br>ATGTATACGGAGGTGGCACTGCCGTGACTGTGAATGCGGCC |
| 15 | 81 | GACAGTGGCACGTATCGATGCAACGTANNKNNKNNKDRYDRYDRYNNKNNKNNKNNKG<br>ATGTATACGGAGATGGCACTGCCGTGACTGTGAATGCGGCC |
| 16 | 82 | GACAGTGGCACGTATCGATGCAACGTANNKNNKNNKNNKNNKNNKTGCNNKNNKNN<br>NKGATGTATACGGAGGTGGCACTGTCGTGACTGTGAATGCGGCC |
| 17 | 83 | GACAGTGGCACGTATCGATGCAACGTANNKNNKNNKNNKNNKNNKTGCNNKNNKNN<br>NKGATGTATACGGAGGTGGCACTGCCGTGACTGTGAATGCGGCC |
| 18 | 84 | GACAGTGGCACGTATCGATGCAACGTANNKNNKNNKNNKNNKNNKTGCNNKNNKNN<br>NKGATGTATACGGAGATGGCACTGCCGTGACTGTGAATGCGGCC |
| 19 | 85 | GACAGTGGCACGTATCGATGCAACGTANNKNNKNNKNNKNNKDRYDRYDRYNNKNNKN<br>NKGATGTATACGGAGGTGGCACTGTCGTGACTGTGAATGCGGCC |
| 20 | 86 | GACAGTGGCACGTATCGATGCAACGTANNKNNKNNKNNKNNKDRYDRYDRYNNKNNKN<br>NKGATGTATACGGAGGTGGCACTGCCGTGACTGTGAATGCGGCC |
| 21 | 87 | GACAGTGGCACGTATCGATGCAACGTANNKNNKNNKNNKNNKDRYDRYDRYNNKNNKN<br>NKGATGTATACGGAGATGGCACTGCCGTGACTGTGAATGCGGCC |
| 22 | 88 | GACAGTGGCACGTATCGATGCAACGTANNKNNKNNKNNKNNKNNKTGCNNKNNKN<br>NKNNKGATGTATACGGAGGTGGCACTGTCGTGACTGTGAATGCGGCC |
| 23 | 89 | GACAGTGGCACGTATCGATGCAACGTANNKNNKNNKNNKNNKNNKTGCNNKNNKN<br>NKNNKGATGTATACGGAGGTGGCACTGCCGTGACTGTGAATGCGGCC |
| 24 | 90 | GACAGTGGCACGTATCGATGCAACGTANNKNNKNNKNNKNNKNNKTGCNNKNNKN<br>NKNNKGATGTATACGGAGATGGCACTGCCGTGACTGTGAATGCGGCC |
| 25 | 91 | GACAGTGGCACGTATCGATGCAACGTANNKNNKNNKNNKNNKDRYDRYDRYNNKN<br>NKNNKGATGTATACGGAGGTGGCACTGTCGTGACTGTGAATGCGGCC |
| 26 | 92 | GACAGTGGCACGTATCGATGCAACGTANNKNNKNNKNNKNNKDRYDRYDRYNNKN<br>NKNNKGATGTATACGGAGGTGGCACTGCCGTGACTGTGAATGCGGCC |
| 27 | 93 | GACAGTGGCACGTATCGATGCAACGTANNKNNKNNKNNKNNKDRYDRYDRYNNKN<br>NKNNKGATGTATACGGAGATGGCACTGCCGTGACTGTGAATGCGGCC |
| 28 | 94 | GACAGTGGCACGTATCGATGCAACGTANNKNNKNNKNNKNNKNNKTGCNNKNNKN<br>NKNNKNNKGATGTATACGGAGGTGGCACTGTCGTGACTGTGAATGCGGCC |
| 29 | 95 | GACAGTGGCACGTATCGATGCAACGTANNKNNKNNKNNKNNKNNKTGCNNKNNKN<br>NKNNKNNKGATGTATACGGAGGTGGCACTGCCGTGACTGTGAATGCGGCC |
| 30 | 96 | GACAGTGGCACGTATCGATGCAACGTANNKNNKNNKNNKNNKNNKTGCNNKNNKN<br>NKNNKNNKGATGTATACGGAGATGGCACTGCCGTGACTGTGAATGCGGCC |
| 31 | 97 | GACAGTGGCACGTATCGATGCAACGTANNKNNKNNKNNKNNKDRYDRYDRYNNKN<br>NKNNKNNKGATGTATACGGAGGTGGCACTGTCGTGACTGTGAATGCGGCC |
| 32 | 98 | GACAGTGGCACGTATCGATGCAACGTANNKNNKNNKNNKNNKDRYDRYDRYNNKN<br>NKNNKNNKGATGTATACGGAGGTGGCACTGCCGTGACTGTGAATGCGGCC |
| 33 | 99 | GACAGTGGCACGTATCGATGCAACGTANNKNNKNNKNNKNNKDRYDRYDRYNNKN<br>NKNNKNNKGATGTATACGGAGATGGCACTGCCGTGACTGTGAATGCGGCC |
| 34 | 100 | GACAGTGGCACGTATCGATGCAAGGTANNKNNKNNKNNKNNKNNKTGCNNKNNKN<br>NKNNKNNKNNKGATGTATACGGAGGTGGCACTGTCGTGACTGTGAATGCGGCC |

TABLE 2-continued

Oligonucleotides Used In This Study

| OLIGO-NUCLEO-TIDE NUMBER | SEQ ID NO: | DNA SEQUENCE (5'-3') |
|---|---|---|
| 35 | 101 | GACAGTGGCACGTATCGATGCAAGGTANNKNNKNNKNNKNNKNNKTGCNNKNNKN NKNNKNNKNNKGATGTATACGGAGGTGGCACTGCCGTGACTGTGAATGCGGCC |
| 36 | 102 | GACAGTGGCACGTATCGATGCAAGGTANNKNNKNNKNNKNNKNNKTGCNNKNNKN NKNNKNNKNNKGATGTATACGGAGATGGCACTGCCGTGACTGTGAATGCGGCC |
| 37 | 103 | GACAGTGGCACGTATCGATGCAAGGTANNKNNKNNKDRYNNKDRYNNKDRYNNKNNKN NKNNKNNKNNKGATGTATACGGAGGTGGCACTGTCGTGACTGTGAATGCGGCC |
| 38 | 104 | GACAGTGGCACGTATCGATGCAAGGTANNKNNKNNKDRYNNKDRYNNKDRYNNKNNKN NKNNKNNKNNKGATGTATACGGAGGTGGCACTGCCGTGACTGTGAATGCGGCC |
| 39 | 105 | GACAGTGGCACGTATCGATGCAAGGTANNKNNKNNKDRYNNKDRYNNKDRYNNKNNKN NKNNKNNKNNKGATGTATACGGAGATGGCACTGCCGTGACTGTGAATGCGGCC |
| 40 | 106 | GACAGTGGCACGTATCGATGCAAGGTANNKNNKNNKNNKNNKNNKTGCNNKNNKNNKN NKNNKNNKNNKGATGTATACGGAGGTGGCACTGTCGTGACTGTGAATGCGGCC |
| 41 | 107 | GACAGTGGCACGTATCGATGCAAGGTANNKNNKNNKNNKNNKNNKTGCNNKNNKNNKN NKNNKNNKNNKGATGTATACGGAGGTGGCACTGCCGTGACTGTGAATGCGGCC |
| 42 | 108 | GACAGTGGCACGTATCGATGCAAGGTANNKNNKNNKNNKNNKNNKTGCNNKNNKNNKN NKNNKNNKNNKGATGTATACGGAGATGGCACTGCCGTGACTGTGAATGCGGCC |
| 43 | 109 | GACAGTGGCACGTATCGATGCAAGGTANNKNNKNNKNNKNNKNNKDRYDRYDRYNNKN NKNNKNNKNNKGATGTATACGGAGGTGGCACTGTCGTGACTGTGAATGCGGCC |
| 44 | 110 | GACAGTGGCACGTATCGATGCAAGGTANNKNNKNNKNNKNNKNNKDRYDRYDRYNNKN NKNNKNNKNNKGATGTATACGGAGGTGGCACTGCCGTGACTGTGAATGCGGCC |
| 45 | 111 | GACAGTGGCACGTATCGATGCAAGGTANNKNNKNNKNNKNNKNNKDRYDRYDRYNNKN NKNNKNNKNNKGATGTATACGGAGATGGCACTGCCGTGACTGTGAATGCGGCC |
| 46 | 112 | GACAGTGGCACGTATCGATGCAAGGTANNKNNKNNKNNKNNKNNKNNKNNKNNKNNKT GCNNKNNKNNKNNKNNKGATGTATACGGAGGTGGCACTGTCGTGACTGTGAATGCGGC C |
| 47 | 113 | GACAGTGGCACGTATCGATGCAAGGTANNKNNKNNKNNKNNKNNKNNKNNKNNKNNKT GCNNKNNKNNKNNKNNKGATGTATACGGAGGTGGCACTGCCGTGACTGTGAATGCGGC C |
| 48 | 114 | GACAGTGGCACGTATCGATGCAAGGTANNKNNKNNKNNKNNKNNKNNKNNKNNKNNKT GCNNKNNKNNKNNKNNKGATGTATACGGAGATGGCACTGCCGTGACTGTGAATGCGGC C |
| 49 | 115 | GACAGTGGCACGTATCGATGCAAGGTANNKNNKNNKNNKNNKNNKNNKNNKDRYDRYD RYNNKNNKNNKNNKNNKGATGTATACGGAGGTGGCACTGTCGTGACTGTGAATGCGGC C |
| 50 | 116 | GACAGTGGCACGTATCGATGCAAGGTANNKNNKNNKNNKNNKNNKNNKNNKDRYDRYD RYNNKNNKNNKNNKNNKGATGTATACGGAGGTGGCACTGCCGTGACTGTGAATGCGGC C |
| 51 | 117 | GACAGTGGCACGTATCGATGCAAGGTANNKNNKNNKNNKNNKNNKNNKNNKDRYDRYD RYNNKNNKNNKNNKNNKGATGTATACGGAGATGGCACTGCCGTGACTGTGAATGCGGC C |
| 52 | 118 | GGTGGCACGTATCGTTGCGGTGTCTGCNNKNNKNNKNNKNNKNNKNNKNNKNNKT GTGATNNKNNKNNKNNKNNKNNKNNKNNKNNKNNKNNKNNKNNKNNKNNKGC TGCATGCGGAGATGGCACT |
| 53 | 119 | GGTGGCACGTATCGTTGCGGTGCCNNKNNKNNKNNKNNKNNKNNKNNKTGTGACN NKNNKNNKNNKNNKTGTNNKNNKNNKNNKNNKNNKNNKGCTGCATGCGGAGATGGCAC T |
| 54 | 120 | GGTGGCACGTATCGTTGCGGTGTCNNKNNKNNKNNKNNKNNKNNKNNKNNKTGTG ACNNKNNKNNKNNKNNKNNKNNKTGCNNKNNKNNKNNKNNKGCTGCATGCGGAGATGGCAC T |
| 55 | 121 | ACCGCAACGATACGTGCCACC |

Based on previous observations (FIGS. 3-4), the amino acid sequence "CNV" was used in front of short CDR3s while the sequence "CKV" was used in front of longer CDR3s. The last two amino acids of the CDR3 were fixed as amino acids "DV" for each of the CDR3 lengths and the three prevalent sequence permutations downstream of the CDR3 were incorporated in the oligonucleotide design. The cysteine residue was incorporated in the CDR3 by either fixing a TGC codon in the oligonucleotide at the preferred cysteine position, or by introducing three DRY degenerate codons (⅙ chance to form a cysteine) at the preferred cysteine position and the two immediately adjacent residues. The remaining codons of the CDR3 were mutated to the NNK degenerate codon, which encodes all 20 amino acids plus the amber stop codon. Six degenerate oligonucleotides were thus designed for every CDR3 length (Table 2), and used as an equimolar mixture together with the ten templates and a specific reverse oligonucleotide to generate the right arm.

Both PCR fragments were digested with DpnI and purified using the Qiaquick gel extraction kit (Qiagen). Purified Left- and Right-arms were then mixed together and the overlap reaction was performed by PCR, using the same conditions as for the left- and right-arm fragments but for 10 cycles only. Oligonucleotides 1 and 3 were then added to the reaction, which was run for 30 cycles using the same PCR conditions. The reaction was finally purified using Qiaquick PCR purification kit (Qiagen) and digested with SfiI. The digested fragment was ligated into the pOsD2 vector and the ligation reaction was transformed into hypercompetent TG1 *E. coli* cells. The number of transformants was estimated by plating an aliquot of cells on TYE-Ampicillin plates and counting the resistant colonies. The calculated size of the library was $1.6 \times 10^{10}$ cfu.

The library was rescued by growing 25 times the library size and infecting with M13KO7 helper phage. Supernatant was collected and bacteriophage were precipitated twice in [PEG (20%); NaCl (2.5M)], resuspended in PBS-20% Glycerol, and frozen in aliquots at −80° C. The phage titer was estimated by infecting serially-diluted phage sample into ER2738 *E. coli* cells and counting the number of ampicillin-resistant colonies.

Once both arms had been synthesised, they were hybridized and amplified by PCR to generate the final semi-synthetic VNAR molecules. After restriction enzyme digestion, products were ligated into a cloning vector. The cloning vector used in this study was pOsD2, a modified version of pSEX81 (Progen) in which a 6×His tag (SEQ ID NO: 546), a FLAG tag, and an amber stop codon were introduced between the VNAR insertion site—between SfiI sites—and the full-length PIII protein of the M13 bacteriophage. Briefly, this vector was generated by inserting a SfiI site downstream from the PelB signal sequence of pSEX81 by the Quickchange method using the following oligonucleotides:

```
                                    (SEQ ID NO: 122)
5'-AGCCGGCCATGGCCcaggCgGCCctggtgcagtctggag-3'
and
                                    (SEQ ID NO: 123)
5'-CTCCAGACTGCACCAGGGCCGCCTGGGCCATGGCCGGCT-3'.
```

The tags, together with a second SfiI site and an amber stop codon, were subsequently introduced in the resulting plasmid—digested with NotI and BamHI—by annealing and ligating

```
                                    (SEQ ID NO: 124)
5'-GGCCGCGGCCTCAGGGGCCCACCATCACCATCACCATGGCGCAGACT
ACAAGGACGACGACGACAAGTAGG-3'
and
                                    (SEQ ID NO: 125)
5'-GATCCCTACTTGTCGTCGT CGTCCTTGTAGTCTGCGCCATGGTGAT
GGTGATGGTGGGCCCCTGAGGCCGC-3'.
```

Semi-synthetic VNAR molecules ligated into vectors as described above were then transformed into *E. coli* TG1 cells ($1.6 \times 10^{10}$ cfu) and rescued in M13 bacteriophage for use in phage display selections.

Example 3. Sequence Analysis of the VNAR Type 2 Semi-Synthetic Library (OsX-3)

The molecular quality of the OsX-3 library was assessed by sequencing the VNAR inserts of 96 randomly-picked clones, as previously described in Example 1. A bioinformatic analysis of the results showed that only 15% of the sequenced clones expressed a VNAR sequence which was frame-shifted in its CDR3. Over half (52%) of the clones expressed a functional Type 2 VNAR, while 32% of the clones expressed a potentially unstable molecule (having one or more unpaired cysteine residues in the expressed molecule). Alignment of all sequenced molecules revealed that the semi-synthetic Type 2 VNARs display the expected sequence variability in both the framework and in the CDR3 regions (FIG. 8).

Type 2 Library Consensus

The percentage of each particular amino acid occurring at each position of the VNAR backbone was determined in three pools of sequences. The naïve pool (composed of 188 sequences), the final semi-synthetic library (composed of 72 sequences), and a theoretical library (composed of the 10 templates in equal amounts (n=10)). These three sets of values were then compared to each other at every position which was mutated, as compared to the germline transcript, in at least one of the ten templates (22 positions in total). The extracted data are shown in the following table:
of values were then compared to each other at every position which was mutated, as compared to the germline transcript, in at least one of the ten templates (22 positions in total). The extracted data are shown in the following table:

TABLE 3

Semi-synthetic Type 2 VNAR library sequences

| Code | Position | Amino acid | Naïve % | Theoretical % | Observed % |
|---|---|---|---|---|---|
| X1 | 8 | Q | 97.3 | 90 | 93.1 |
| X1 | 8 | R | 2.13 | 10 | 6.94 |
| X2 | 9 | T | 97.3 | 90 | 93.1 |
| X2 | 9 | S | 2.66 | 10 | 6.94 |
| X3 | 10 | I | 96.8 | 80 | 76.4 |
| X3 | 10 | V | 2.13 | 20 | 23.6 |
| X4 | 27 | S | 93.6 | 90 | 94.4 |
| X4 | 27 | N | 2.13 | 10 | 5.56 |
| X5 | 28 | N | 93.1 | 90 | 88.9 |
| X5 | 28 | I | 1.6 | 10 | 11.1 |
| X6 | 30 | A | 92 | 80 | 81.9 |
| X6 | 30 | D | 1.6 | 10 | 8.33 |
| X6 | 30 | E | 1.06 | 10 | 9.72 |
| X7 | 32 | S | 92.6 | 90 | 86.1 |
| X7 | 32 | P | 1.06 | 10 | 12.5 |
| X8 | 33 | S | 85.6 | 70 | 73.6 |
| X8 | 33 | R | 5.32 | 10 | 8.33 |
| X8 | 33 | T | 0.53 | 10 | 8.33 |
| X8 | 33 | N | 2.66 | 10 | 9.72 |
| X9 | 34 | T | 98.9 | 90 | 90.3 |

TABLE 3-continued

Semi-synthetic Type 2 VNAR library sequences

| Code | Position | Amino acid | Naïve % | Theoretical % | Observed % |
|---|---|---|---|---|---|
| X9 | 34 | L | 0.53 | 10 | 9.72 |
| X10 | 35 | Y | 94.1 | 80 | 70.8 |
| X10 | 35 | H | 1.06 | 10 | 8.33 |
| X10 | 35 | L | 1.06 | 10 | 20.8 |
| X11 | 39 | K | 94.1 | 90 | 77.8 |
| X11 | 39 | T | 2.13 | 10 | 22.2 |
| X12 | 42 | G | 95.7 | 90 | 90.3 |
| X12 | 42 | D | 2.13 | 10 | 9.72 |
| X13 | 44 | T | 95.7 | 90 | 77.8 |
| X13 | 44 | R | 2.66 | 10 | 22.2 |
| X14 | 47 | E | 96.8 | 90 | 88.9 |
| X14 | 47 | A | 0.53 | 10 | 11.1 |
| X15 | 48 | S | 87.2 | 70 | 79.2 |
| X15 | 48 | N | 4.79 | 20 | 9.72 |
| X15 | 48 | R | 1.6 | 10 | 11.1 |
| X16 | 51 | K | 95.7 | 90 | 88.9 |
| X16 | 51 | L | 1.6 | 10 | 11.1 |
| X17 | 69 | R | 97.9 | 80 | 79.2 |
| X17 | 69 | K | 1.6 | 20 | 20.8 |
| X18 | 74 | T | 94.7 | 90 | 95.8 |
| X18 | 74 | V | 1.6 | 10 | 4.17 |
| X19 | 76 | E | 97.3 | 90 | 90.3 |
| X19 | 76 | K | 0.53 | 10 | 9.72 |
| X20 | 84 | N | 53.2 | 62.5 | 63.9 |
| X20 | 84 | K | 40.4 | 37.5 | 36.1 |
| X21 | 94 | G | 79.3 | 66.6 | 75 |
| X21 | 94 | D | 20.7 | 33.3 | 25 |
| X22 | 97 | V | 51.1 | 33.3 | 34.7 |
| X22 | 97 | A | 48.9 | 66.6 | 65.3 |

Generally, the theoretical and observed percentages showed very close values. A general consensus for the semi-synthetic Type 2 library was deduced from these data by comparing the percentages observed in the nave repertoire pool with those observed from the semi-synthetic library at each mutated position.

Example 4. Characterization of the VNAR Type 2 Semi-Synthetic Library (OsX-3)

In order to test physical complexity, the VNAR Type 2 semi-synthetic OsX-3 library generated in Example 2 was used in two concurrent phage display selections on two different target proteins, namely, human BAFF and human Transferrin Receptor (hTfR). Synthetic VNARs specifically binding to these target proteins were isolated by four rounds of selection and amplification of the library on immobilized human BAFF or hTfR recombinant proteins, respectively (see also, e.g., Example 8). In order to select for high affinity clones, the stringency of selection was increased at each round by decreasing the target protein concentration and increasing the number of washing steps.

The efficiency of the selection procedure was first assessed by plotting the percentage of eluted phage after each selection round. A 3000-fold increase in phage recovery was observed between rounds two and four of both selections (FIG. 9). The binding specificity of the selected phage was then confirmed by a polyclonal phage ELISA in which three different coatings were used (BAFF, hTfR, and human serum albumin "as" as a control). A strong increase in binding phage was observed from round 3 on both selections, specifically on the target-coated surfaces and not on other coatings.

After selection rounds three and four, 93 individual clones were picked from each of the BAFF and hTfR selections. BAFF selection output clones were grown in 96 deep-well plates in auto-induction medium (Novagen) and periplasmic protein was extracted by osmotic shock. hTfR output clones were grown in 2XTY before being infected with M13KO7 helper phage, and a phage-enriched supernatant was collected after 12-16 hours. Both the periplasmic extract and the phage supernatant were then used to assess the binding capacity of individual clones in a binding ELISA, on Maxisorp 96 well plates coated with either BAFF-Fc, hTfR or HSA. Specific clones were selected using the criteria that their signal on the target protein-coated surface should be at least four times superior to their signal on HSA signal (see Example 8).

Figure 10A:
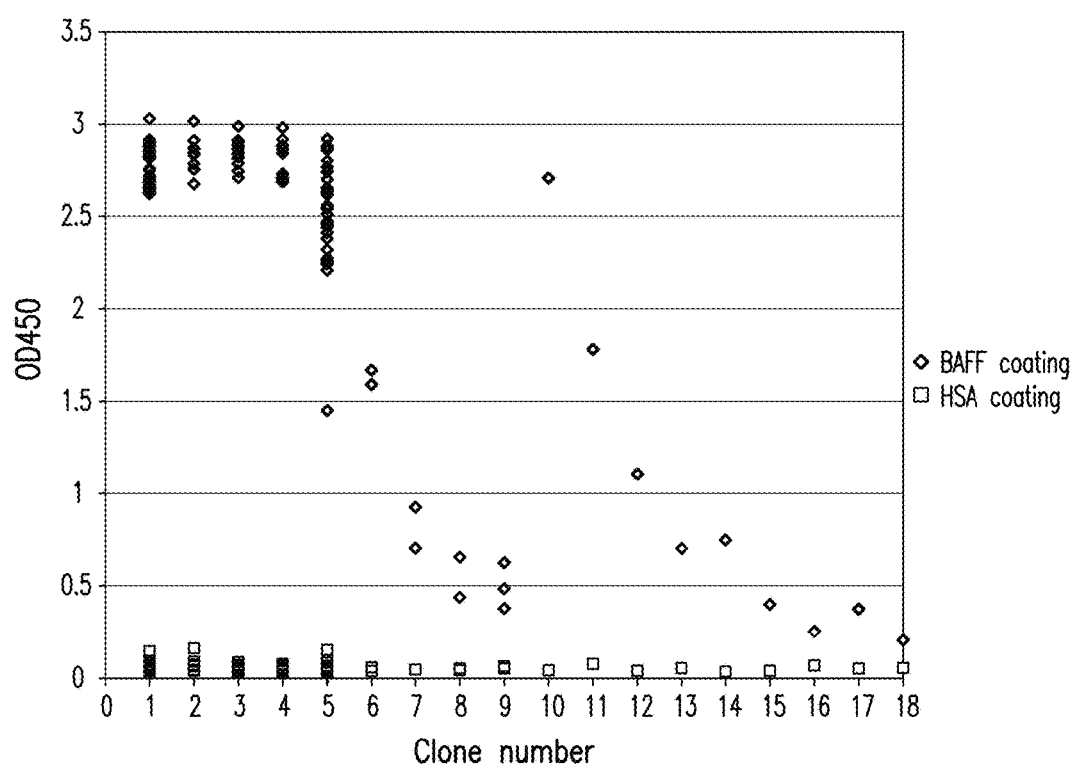
Figure 10B:
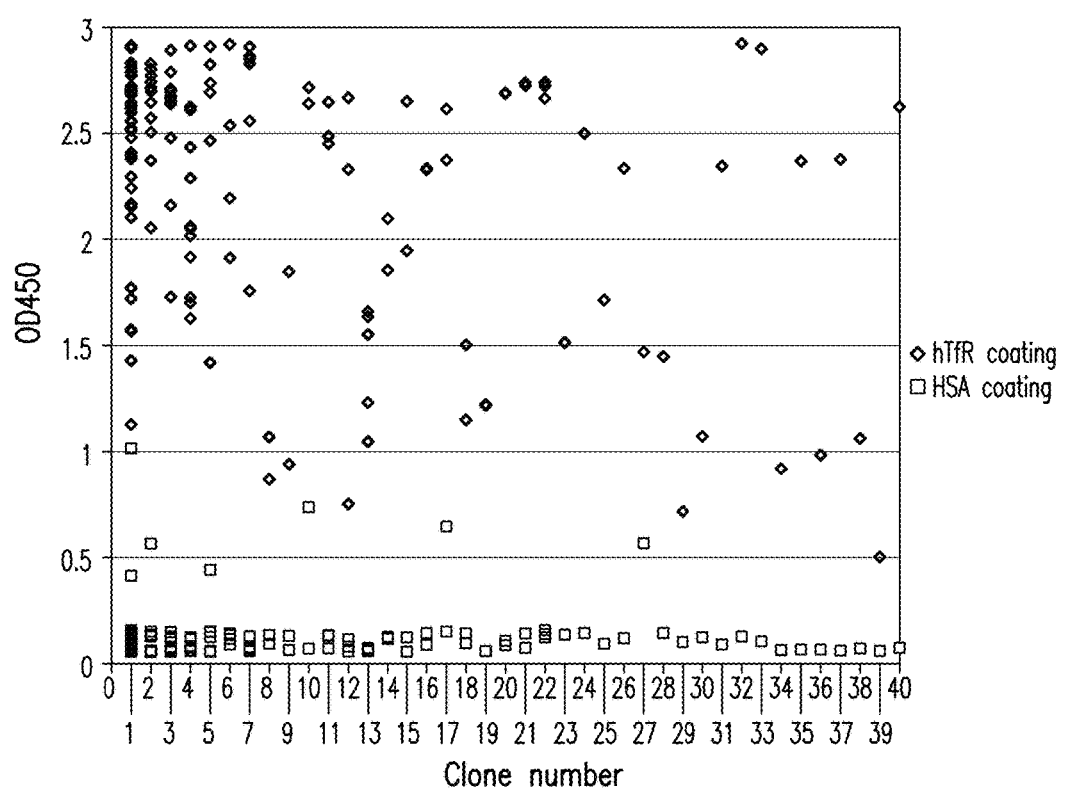

The DNA sequence of positive clones was determined by the Sanger chain termination method (GATC biotech), using the specific oligonucleotide and positive clones were sorted into different categories based on their protein sequence. Eighteen different specific clones were identified in the BAFF selection, nine of which were found more than once in the sequenced panel (FIG. 10A). In the hTfR selection, forty different specific clones were identified, twenty of which were found more than once in the sequenced panel (FIG. 10B). Sequence analysis of the BAFF-binding clones revealed that 72% of the specific clones harboured a DXL motif in their CDR3. This short motif is present in the BAFF receptor and has been shown to account for a major part of the interaction between BAFF and its receptor (Kim et al. 2003, Liu et al. 2003, Gordon et al. 2003). The presence of thirteen different VNAR variants harbouring this feature in the output of the BAFF selection suggests that the functional diversity of the OsX-3 library is very high.

Example 5. Identification of Nurse Shark VNAR Type 1 Sequences

To identify nurse shark Type 1 VNAR sequences (which have longer CDR3 regions than those of Type 2) we used the same sequence collection as described in Example 1. We extracted all Type 1 molecules from the database and measured the CDR3 length of each clone. It was known already that Type 1 VNARs have, on average, longer CDR3s than do Type 2 VNARs (Diaz et al. 2002, Barelle et al. 2009). We identified three molecules whose CDR3s were unusually extended. Two of the clones harboured a 26 amino acid-long CDR3, and one harboured a 32 amino acid-long CDR3 (FIG. 11). Reports in the literature have characterized Type 1 CDR3s as being 21 amino acids long, on average. In our studies, the average length of a Type 1 CDR3 appeared to be closer to 19 amino acids.

Example 6. Design and Generation of a Type 1 Semi-Synthetic VNAR Library Harbouring Long CDR3s (OsX-4)

To generate a semi-synthetic Type 1 VNAR library biased for long CDR3 regions, we randomized the CDR3 of the three clones we identified, without any further framework mutations, by overlap PCR as described above in Example 2 (FIG. 5). To preserve the structural integrity of the loop, we kept the position of the two cysteines in the CDR3 unchanged. An aspartate (D) residue, which was conserved in all three clones, was also fixed in the design as were the last two amino acids of the CDR3, which are a conserved alanine pair in Type 1 VNARs (contrary to the conserved DV in Type 2 VNARs described above). All remaining codons of the CDR3 were mutated to the degenerate codon NNK (FIG. 12).

The oligonucleotides used for generating the OsX-4 library are listed in Table 2 (Example 2). The left arm fragments of each of the three template VNARs were synthesized by PCR for 30 cycles at 98° C. (15 seconds), 62° C. (30 seconds), 72° C. (30 seconds), using Phusion 2× Mastermix (Thermo Scientific) and oligonucleotides 1 and 55. The right arm fragments were synthesized independently for each of the three templates using oligonucleotides 3 and 52 for template 32mer, oligonucleotides 3 and 53 for template 26merA, and oligonucleotides 3 and 54 for template 26-merB.

The left and right arms of each clone were amplified independently using specific oligonucleotides before being hybridized and re-amplified. The final fragments were ligated into the pOsD2 vector and transformed into TG1 cells as described in Example 2 for the OsX-3 library. Libraries generated from each of the three template VNARs were mixed and the calculated final number of transformants was $5.0 \times 10^9$ cfu.

Example 7. Sequence Analysis of the VNAR Type 1 Semi-Synthetic Library (OsX-4)

The molecular quality of the OsX-4 library was assessed by sequencing the VNAR insert of randomly-picked clones, as described in Example 3 for the OsX-3 library. A bioinformatics analysis of the results showed that 32% of the sequenced clones expressed a VNAR sequence that was frame-shifted in its CDR3). Another 32% of the sequenced clones expressed a functional Type 1 VNAR, while the remaining 36% of the sequenced clones expressed a potentially unstable molecule (mostly those containing an uneven number of cysteine residues in the CDR3 region, leading to unpaired cysteines in the expressed molecule). Further analyses of the sequenced clones also showed that, due to the "imprecise" nature of the degenerate oligonucleotides synthesis, several VNAR molecules harboured a CDR3 whose length was either shorter than 26 amino acids, or comprised between 27 and 30 amino acids (FIG. 13), which further expanded the physical complexity of the library.

Example 8. Phage Display Selection of VNARs Having Particular Binding Properties Selection of interacting VNARs isolated from OsX-3 (Example 4), displayed as a fusion of the PIII protein on M13 bacteriophage, was performed essentially as described in (Griffiths et al. 1994, EMBO J., 13:3245-3260). Briefly, human BAFF (ProSpec) or human Transferrin Receptor TFR-(Sino Biological) or human myostatin (Peprotech) were immobilized on Nunc Maxisorp 96-well plates and exposed to an excess (about 100 times the library size) of phage rescued from the OsX-3 library. After a 1.5-hour incubation at room temperature, unbound particles were removed by washing, first in PBS-0.1% Tween and then in PBS. The bound phage were subsequently eluted with triethylamine (100 mM) and quickly neutralized in Tris (pH=7.5). Eluted particles were then used to infect E. coli ER2738. A portion of the culture was used to estimate the titer of eluted phage (by counting the number of antibiotic-resistant colonies), and the rest of the culture was infected with M13K07 helper phage to produce phage for the next round of selection. Up to four rounds of selection were performed using increasingly stringent conditions consisting in progressively reducing the coated target protein concentration at every round (50, 5.0, 2.5, and 1 µg/mL respectively), and increasing the washing steps from 10 to 20.

Phage populations were tested for specificity to the target protein by polyclonal phage ELISA. Briefly $1 \times 10^{12}$ phage were incubated in Nunc Maxisorp 96-well plates coated at 1 µg/mL with either BAFF-Fc (Sino Biological), TfR-1, myostatin or HSA (Sigma) as a negative control. After incubating at room temperature for one hour, the unbound particles were removed by washing the wells three times in first in PBS-0.1% Tween-20. Bound bacteriophage was then detected using a specific anti-M13 antibody (GE) (see e.g., FIG. 14).

After selection rounds three and four, individual clones were picked and grown in 96-well format. BAFF and myostatin output clones were grown in auto-induction medium (Novagen) for 18-20 hours and periplasmic protein was extracted by osmotic shock essentially as described (Müller et al., Methods Mol Biol. 2012; 907:177-94). Human TfR-1 output clones were grown in 2XTY until mid-log phase was reached. M13K07 helper phage was then added ($>1 \times 10^{10}$ helper phage/well) and the infection was allowed to proceed for 30 minutes at 37° C. The medium was then exchanged for Kanamycin-containing 2XTY and the culture was incubated overnight at 30° C., 250 rpm. The culture was then spun down and the phage-enriched supernatant was collected.

Periplasmic protein and phage supernatants were directly tested in a binding ELISA. Nunc Maxisorp 96-well plates were coated at 1 µg/mL with either BAFF-Fc, hTfR-1, myostatin or HSA as a negative control. Periplasmic fractions and phage supernatants were pre-blocked in PBS-0.1% Tween+2.5% milk before being exposed to the coated surface. After washing in PBS-0.1% Tween, bound molecules were detected using a peroxidase-conjugated anti-FLAG antibody (Sigma) for monomeric VNARs, and using a peroxidase conjugated anti-M13 antibody for the phage. Absorbance at 450 nm was recorded using an Envision multiwell reader (Perkin Elmer) and specific clones were selected using the criteria that their signal on the target protein must be at least four times superior to their respective signal on HSA. The DNA sequence of positive clones was determined as previously described in Example 1 and those with unique CDR3 sequences were selected for further characterization.

Expression and Purification of Monomeric VNARs

Selected target antigen-binding clones were expressed at larger scale in order to purify monomeric VNARs for biochemical analysis. Cultures (500 mL) were grown in auto-induction medium (Novagen) and periplasmic fraction was extracted by osmotic shock by resuspending the bacteria in TES buffer (50 mM Tris, 1 mM EDTA, 20% Sucrose w/v) mixed with an equal volume of TES diluted 1:5 in water. After 30 minutes on ice, the lysate was clarified by centrifugation and the salt concentrations were adjusted to 500 mM NaCl and 10 mM imidazole in 1×PBS. The periplasmic fraction was then purified on Nickel-Sepharose resin (Qiagen), washed in 1×PBS, 10 mM imidazole, 500 mM NaCl, and then eluted in 1×PBS, 500 mM imidazole, 500 mM NaCl. The purified protein was then buffer-exchanged against PBS and concentrated by centrifugation with Vivaspin 20 filters (Sartorius, MWCO 5000). Endotoxin was subsequently removed from the protein sample using VivaPure Q mini column (Sartorius) and the protein was sterile filtered (0.22 µm). After estimating the protein concentration using Bradford reagent (Pierce), the purified protein was frozen in aliquots.

Expression and Purification of VNAR-Fc Fusions

Selected VNARs were produced in CHO cells as fusions to the N-terminus of the IgG-Fc fragment via a (Gly)4-Ser linker (SEQ ID NO: 126). Tissue culture supernatants containing the VNAR-Fc were purified using Protein A affinity chromatography. Samples were added to a Mab Select Sure column (GE), washed with 20 mM phosphate, 150 mM NaCl, pH 7.4 and eluted with 0.1 M glycine-HCl, pH 3. Eluted samples were neutralised with 1 M Tris, pH 8 and then buffer-exchanged against PBS and concentrated by centrifugation with Vivaspin 20 filters (Sartorius, MWCO 10,000) and then sterile filtered (0.22 µm). Protein concentration was determined by absorbance measured at 280 nm. Binding EC50 values were determined as for monomers with the exception of the use of an anti-Fc peroxidase conjugate as a detection antibody.

Determining Biochemical EC50 Values

The biochemical EC50 (equilibrium constant, the concentration at which the ratio of bound to unbound is 50:50) of selected clones was determined by serially diluting purified monomeric VNARs or VNAR-Fc fusion proteins in blocking buffer (PBS-0.1% Tween+2.5 milk) and exposing it to preblocked Nunc Maxisorp 96-well plates coated at 1 µg/mL with BAFF-Fc (Sino Biological). After washing in PBS-0.1% Tween-20, bound VNARs were detected using a peroxidase-conjugated anti-FLAG antibody (Sigma). Absorbance at 450 nm was recorded using an Envision multiwell reader (Perkin Elmer) and EC50s were calculated by fitting curves (non-linear regression) using GraphPad Prism®.

Polyclonal phage ELISA were performed on VNAR selection outputs. Phage ($1\times10^{12}$) from each round's input were incubated in microwells coated with either BAFF, hTfR, or HSA. After washing, bound phage was detected with a specific anti-M13 antibody as described above. A selective increase in phage binders to BAFF (FIG. 14), myostatin (FIG. 15) and hTfR-1 (FIG. 16) relative to the negative controls (HSA) occurred after 3 rounds of panning. FIG. 15 shows enrichment of myostatin binders after successive rounds of panning. Phage populations after each round of panning on myostatin-coated plates were tested for binding to myostatin or HSA (negative control) by polyclonal phage ELISA. FIG. 16 shows the enrichment of rhTfR-1 binders after successive rounds of panning. A selective increase in phage binders to rhTfR-1 relative to the negative controls occurred after 3 rounds of panning.

FIG. 17 shows EC50 binding curves of selected clones to immobilized BAFF. HSA-1B8 is a non-specific VNAR used as a negative control. The observed EC50s for five different VNARs ranged from 0.5 to 17 nM.

FIG. 18 shows EC50 binding curves of selected VNAR-Fcs to myostatin. Selected VNARs that bound to myostatin blocked its interaction with the ActRIIb receptor (not shown) as monomers were reformatted as Fc-fusion proteins and retested for binding activity. EC50 values for 8H8-Fc, 8B10-Fc and 9B11-Fc were 1 nM, 38 nM and 17 nM, respectively (Example 10).

FIG. 19 shows EC50 binding curves of selected clones to immobilized TfR-1. Monomeric VNARs that internalized into either mouse or human cells when expressed as VNAR-Fc fusion proteins were selected for a range of binding potencies to recombinant human (A) or recombinant mouse (B).

Example 9. In Vitro Activity of hBAFF Synthetic VNAR Binding Moieties

Determining Biochemical IC50 Values

The biochemical IC50 (inhibition constant, the concentration which inhibits binding of one agent to another agent by 50%) of selected clones was determined by serially diluting purified monomeric VNARs in blocking buffer (PBS-0.1% Tween-20+2.5% milk) supplemented with 1.14 nM BAFF-Fc. The pre-blocked proteins were then exposed to Nunc Maxisorp 96-well plates were coated at 1 µg/mL with the BAFF-R extracellular domain, preblocked in (PBS-0.1% Tween+2.5% milk). After washing in PBS-0.1% Tween, BAFF bound to its receptor was detected via its Fc moiety using a peroxidase-conjugated anti-human Fc (Sigma #A0170). Absorbance at 450 nm was recorded using an Envision multiwell reader (Perkin Elmer) and IC50 values were calculated by fitting the curves (non-linear regression) using GraphPad Prism®.

Measuring BAFF VNAR Binding Affinities

Surface Plasmon Resonance provides a definitive measure of the affinity of an interaction and may be used to measure affinity of binding by a BAFF binding moiety or BAFF antagonist compound of the invention to a selected target compound, such as human BAFF, mouse or mammalian non-human BAFF, or a putative cross reactive compound such as APRIL. Specific VNARs of the invention were immobilized on flow cells at a density of approximately 500RUs (response units). Recombinant BAFF was then applied in the fluid phase at a flow rate of 20 µl/min with association for 2 minutes, followed by dissociation for 30 minutes at a range of at least 6 concentrations from 1 µM to 1 pM. The sensorgrams were then modeled to determine the kinetic properties of the interaction including rate of association, dissociation and the affinity of the interaction.

In Vitro Functional Activity of BAFF Antagonists

The BAFF-specific VNARs were tested for their ability to antagonize BAFF-induced B cell proliferation. Mouse splenocytes were obtained by dissociating spleens of C57BL/6 mice on a 70 µm cell strainer and lysing red blood cell in RBC buffer (Sigma). B cells were then purified by depleting CD43-positive cells using magnetic microbeads (Miltenyi Biotec) according to manufacturer's instructions. The obtained B cells were subsequently stimulated with goat anti-mouse IgM antibody (Jackson Laboratories) at 10 µg/mL final assay concentration. Recombinant VNARs were serially-diluted and pre-complexed with recombinant BAFF-Fc at 5 ng/mL final assay concentration in RPMI 1640 supplemented with 10% FBS, for 30 minutes at 37° C. Stimulated B cells were added to the pre-complexed proteins and further incubated for 72 hours at 37° C., 5% $CO_2$. Cell proliferation was then estimated by incubating cells with WST-1 reagent (Roche) and reading absorbance at 450 nM, subtracting a reference wavelength at 595 nM. IC50 values were calculated by fitting the curves (non-linear regression) using GraphPad Prism®.

FIG. 20 shows inhibition of BAFF bioactivity in the mouse splenocyte assay. Mouse splenic B cells were exposed to BAFF in the presence or in the absence of five different VNARs. HSA-1B8 is a non-specific VNAR used as a negative control The range of IC50 for the VNAR antagonists (60 to 200 nM) was similar to that of the endogenous BAFF receptor, BR3 (121 nM).

Example 10. In Vitro Activity of Human Myostatin Synthetic VNAR Binding Moieties Selection of human myostatin-interacting VNAR binding moieties in clones isolated from the OsX-3, displayed as a fusion of the PIII protein on M13 bacteriophage, was performed as described above (Example 8). These synthetic VNARs were tested for their ability to reverse the growth inhibition of myostatin. MPC11 cells (Sigma) were seeded into a 96-well plate at $1\times10^4$ cells per well in DMEM, in 20% horse serum (Gibco) supplemented with 50 ng/ml myostatin (R&D). The cells were then grown for three days in the presence of each test VNAR-Fc (at 50 nM and 250 nM). The endogenous myostatin inhibitor, follistatin (R&D), was used as a positive control at 100 ng/ml. Proliferation was determined by the addition of a MTS/PMS substrate and measuring absorbance at 490 nm. Significance was determined using the Dunnett's multiple comparison test for each group relative to cells in the presence of myostatin alone.

FIG. 21 shows reversal of growth inhibition by myostatin in MPC11 cells. Two of the three VNAR-Fcs against myostatin were as active as the endogenous inhibitor follistatin at 250 nM (FIG. 21A). At 50 nM, 8H8-Fc was more efficacious than follistatin and restored growth of MPC11 cells to control levels.

Example 11. In Vitro Activity of hTfR-1 Synthetic VNAR Binding Moieties

Selection of human TfR-1 interacting VNARs isolated from OsX-3 was performed as described above (Example 8). The ability of these synthetic VNARs to recognize recombinant human TfR-1 expressed on the cell surface and to trigger internalization was examined by immunofluorescent microscopy. Cells seeded in Lab-Tek II Chamber Slide (Nunc) slides were exposed to VNAR monomers or VNAR-Fcs at 1-5 µM in cell culture medium and incubated 1 hour at either 37° C. to allow membrane transport, or on ice to arrest cellular metabolism. The cells were washed 3 times with 200 µl of 3% FBS in PBS (v/v) and fixed with 100 µl of 4% paraformaldehyde in PBS for 20 minutes at room temperature. Cells were then permeabilised with 1% Triton X-100 in PBS for 20 minutes and subsequently incubated with a mouse anti-FLAG antibody diluted 1:5000 (Sigma). After three washes in 3% FBS/PBS, the primary antibody was detected with anti-mouse IgG1 labelled with AlexaFluor-A555 using the same conditions. To detect VNAR-Fc fusions, cells were incubated with a directly labeled anti-human IgG Fc molecule (Abcam AB97004) for one hour at room temperature. Positive control anti-TfR antibodies were detected with appropriate species and isotype specific directly labelled antibodies. Following the staining procedure the chamber slides were disassembled and sealed with coverslips over mounting media containing DAPI nuclear counter-stain and analysed using a laser scanning confocal microscope.

CHO cells expressing recombinant human TfR-1 were incubated prior to fixation with VNAR monomers from clone 101G4 at either 4° C. (A) showing surface staining or at 37° C. (B) showing intracellular staining. Cells were stained with an anti-flag antibody followed by an A555-conjugated anti-mouse antibody and imaged by confocal microscopy. FIG. 22 shows the results of immunofluorescent screening for cell binding and internalization of human TfR-1.

While some embodiments of the invention have been described by way of illustration, it will be apparent that the invention can be put into practice with many modifications, variations and adaptations, and with the use of numerous equivalents or alternative solutions that are within the scope of persons skilled in the art, without departing from the spirit of the invention or exceeding the scope of the claims.

REFERENCES

Müller M R, O'Dwyer R, Kovaleva M, Rudkin F, Dooley H, Barelle C J. Generation and isolation of target-specific single-domain antibodies from shark immune repertoires. Methods Mol Biol. 2012; 907:177-94.

Kim H M, Yu K S, Lee M E, Shin D R, Kim Y S, Paik S G, Yoo O J, Lee H, Lee J O. Crystal structure of the BAFF-BAFF-R complex and its implications for receptor activation. Nat Struct Biol. 2003 May; 10(5):342-8.

Liu Y, Hong X, Kappler J, Jiang L, Zhang R, Xu L, Pan C H, Martin W E, Murphy R C, Shu H B, Dai S, Zhang G. Ligand-receptor binding revealed by the TNF family member TALL-1. Nature. 2003 May 1; 423(6935):49-56.

Gordon N C, Pan B, Hymowitz S G, Yin J, Kelley R F, Cochran A G, Yan M, Dixit V M, Fairbrother W J, Starovasnik M A. BAFF/BLyS receptor 3 comprises a minimal TNF receptor-like module that encodes a highly focused ligand-binding site. Biochemistry. 2003 May 27; 42(20):5977-83.

Diaz M, Stanfield R L, Greenberg A S, Flajnik M F. Structural analysis, selection, and ontogeny of the shark new antigen receptor (IgNAR): identification of a new locus preferentially expressed in early development. Immunogenetics. 2002 October; 54(7):501-12. Epub 2002 Jul. 23.

Barelle C, Gill D S, Charlton K. Shark novel antigen receptors—the next generation of biologic therapeutics? Adv Exp Med Biol. 2009; 655:49-62. doi: 10.1007/978-1-4419-1132-2_6.

All publications, patents, and patent applications are herein incorporated by reference in their entirety to the same extent as if each individual publication, patent or patent application was specifically and individually indicated to be incorporated by reference in its entirety.

SEQUENCE LISTING (546 sequences)

SEQ ID NO: 1 - protein, 25 aa, Artificial Sequence
  source: /note="Description of Artificial Sequence: Synthetic peptide"
  VARIANT (8)..(8): /replace="Arg"
  VARIANT (9)..(9): /replace="Ser"
  VARIANT (10)..(10): /replace="Val"
  misc_feature (1)..(25): /note="Variant residues given in the sequence have no preference with respect to those in the annotations for variant positions"
ARVDQTPQTITKETGESLTINCVLR

SEQ ID NO: 2 - protein, 7 aa, Artificial Sequence
  source: /note="Description of Artificial Sequence: Synthetic peptide"
  VARIANT (2)..(2): /replace="Asn"
  VARIANT (3)..(3): /replace="Ile"
  VARIANT (5)..(5): /replace="Asp" or "Glu"
  VARIANT (7)..(7): /replace="Pro"
  misc_feature (1)..(7): /note="Variant residues given in the sequence have no preference with respect to those in the annotations for variant positions"
DSNCALS

SEQ ID NO: 3 - protein, 11 aa, Artificial Sequence
  source: /note="Description of Artificial Sequence: Synthetic peptide"
  VARIANT (1)..(1): /replace="Arg" or "Thr" or "Asn"
  VARIANT (2)..(2): /replace="Leu"
  VARIANT (3)..(3): /replace="His" or "Leu"
  VARIANT (7)..(7): /replace="Thr"
  VARIANT (10)..(10): /replace="Asp"
  misc_feature (1)..(11): /note="Variant residues given in the sequence have no preference with respect to those in the annotations for variant positions"
STYWYRKKSGS

SEQ ID NO: 4 - protein, 9 aa, Artificial Sequence
  source: /note="Description of Artificial Sequence: Synthetic peptide"
  VARIANT (1)..(1): /replace="Arg"
  VARIANT (4)..(4): /replace="Ala"
  VARIANT (5)..(5): /replace="Asn" or "Arg"
  VARIANT (8)..(8): /replace="Leu"
  misc_feature (1)..(9): /note="Variant residues given in the sequence have no preference with respect to those in the annotations for variant positions"
TNEESISKG

SEQ ID NO: 5 - protein, 8 aa, Artificial Sequence
  source: /note="Description of Artificial Sequence: Synthetic peptide"
GRYVETVN

SEQ ID NO: 6 - protein, 5 aa, Artificial Sequence
  source: /note="Description of Artificial Sequence: Synthetic peptide"
SGSKS

SEQ ID NO: 7 - protein, 20 aa, Artificial Sequence
  source: /note="Description of Artificial Sequence: Synthetic peptide"
  VARIANT (4)..(4): /replace="Lys"
  VARIANT (9)..(9): /replace="Val"
  VARIANT (11)..(11): /replace="Lys"
  VARIANT (19)..(19): /replace="Lys"
  misc_feature (1)..(20): /note="Variant residues given in the sequence have no preference with respect to those in the annotations for variant positions"
FSLRINDLTVEDSGTYRCNV

SEQ ID NO: 8 - protein, 11 aa, Artificial Sequence
  source: /note="Description of Artificial Sequence: Synthetic peptide"
  VARIANT (3)..(3): /replace="Asp"
  VARIANT (6)..(6): /replace="Ala"
  misc_feature (1)..(11): /note="Variant residues given in the sequence have no preference with respect to those in the annotations for variant positions"
YGGGTVVTVNA

SEQ ID NO: 9 - protein, 121 aa, Artificial Sequence
  source: /note="Description of Artificial Sequence: Synthetic polypeptide"
  VARIANT (8)..(8): /replace="Arg"
  VARIANT (9)..(9): /replace="Ser"
  VARIANT (10)..(10): /replace="Val"
  VARIANT (27)..(27): /replace="Asn"
  VARIANT (28)..(28): /replace="Ile"
  VARIANT (30)..(30): /replace="Asp" or "Glu"
  VARIANT (32)..(32): /replace="Pro"
  VARIANT (33)..(33): /replace="Arg" or "Thr" or "Asn"
  VARIANT (34)..(34): /replace="Leu"
  VARIANT (35)..(35): /replace="His" or "Leu"
  VARIANT (39)..(39): /replace="Thr"
  VARIANT (42)..(42): /replace="Asp"
  VARIANT (44)..(44): /replace="Arg"
  VARIANT (47)..(47): /replace="Ala"
  VARIANT (48)..(48): /replace="Asn" or "Arg"
  VARIANT (51)..(51): /replace="Leu"
  VARIANT (69)..(69): /replace="Lys"
  VARIANT (74)..(74): /replace="Val"
  VARIANT (76)..(76): /replace="Lys"
  VARIANT (84)..(84): /replace="Lys"
  MOD_RES (86)..(110): Any amino acid
  VARIANT (93)..(110): /replace=" "
  VARIANT (113)..(113): /replace="Asp"
  VARIANT (116)..(116): /replace="Ala"
  misc_feature (1)..(121): /note="Variant residues given in the sequence have no preference with respect to those in the annotations for variant positions"
ARVDQTPQTITKETGESLTINCVLRDSNCALSSTYWYRKKSGSTNEESISKGGRYVETVNSGSKSFSLRINDLTVEDSGTYRCNVXXXXXXXXXXXXXXXXXXXXXXXXXYGGGTVVTVNA

SEQ ID NO: 10 - protein, 19 aa, Artificial Sequence
  source: /note="Description of Artificial Sequence: Synthetic peptide"
  MOD_RES (3)..(6): Any amino acid
  MOD_RES (8)..(11): Any amino acid
NVXXXXCXXXXDVYGGGTV

SEQ ID NO: 11 - protein, 19 aa, Artificial Sequence
  source: /note="Description of Artificial Sequence: Synthetic peptide"
  MOD_RES (3)..(6): Any amino acid
  MOD_RES (8)..(11): Any amino acid
NVXXXXCXXXXDVYGGGTA

SEQ ID NO: 12 - protein, 19 aa, Artificial Sequence
  source: /note="Description of Artificial Sequence: Synthetic peptide"
  MOD_RES (3)..(6): Any amino acid
  MOD_RES (8)..(11): Any amino acid
NVXXXXCXXXXDVYGDGTA

SEQ ID NO: 13 - protein, 19 aa, Artificial Sequence
  source: /note="Description of Artificial Sequence: Synthetic peptide"
  MOD_RES (3)..(5): Any amino acid
  VARIANT (6)..(8): /replace="Ser" or "Asp" or "Gly" or "Tyr" or "Cys"
  MOD_RES (9)..(11): Any amino acid
  misc_feature (1)..(19): /note="Variant residues given in the sequence have no preference with respect to those in the annotations for variant positions"
NVXXXNNNXXXDVYGGGTV

SEQ ID NO: 14 - protein, 19 aa, Artificial Sequence
  source: /note="Description of Artificial Sequence: Synthetic peptide"
  MOD_RES (3)..(5): Any amino acid
  VARIANT (6)..(8): /replace="Ser" or "Asp" or "Gly" or "Tyr" or "Cys"
  MOD_RES (9)..(11): Any amino acid
  misc_feature (1)..(19): /note="Variant residues given in the sequence have no preference with respect to those in the annotations for variant positions"
NVXXXNNNXXXDVYGGGTA

SEQ ID NO: 15 - protein, 19 aa, Artificial Sequence
  source: /note="Description of Artificial Sequence: Synthetic peptide"
  MOD_RES (3)..(5): Any amino acid
  VARIANT (6)..(8): /replace="Ser" or "Asp" or "Gly" or "Tyr" or "Cys"
  MOD_RES (9)..(11): Any amino acid
  misc_feature (1)..(19): /note="Variant residues given in the sequence have no preference with respect to those in the annotations for variant positions"
NVXXXNNNXXXDVYGDGTA

SEQ ID NO: 16 - protein, 20 aa, Artificial Sequence
  source: /note="Description of Artificial Sequence: Synthetic peptide"
  MOD_RES (3)..(7): Any amino acid
  MOD_RES (9)..(12): Any amino acid
NVXXXXXCXXXXDVYGGGTV

SEQ ID NO: 17 - protein, 20 aa, Artificial Sequence
  source: /note="Description of Artificial Sequence: Synthetic peptide"
  MOD_RES (3)..(7): Any amino acid
  MOD_RES (9)..(12): Any amino acid
NVXXXXXCXXXXDVYGGGTA

SEQ ID NO: 18 - protein, 20 aa, Artificial Sequence
  source: /note="Description of Artificial Sequence: Synthetic peptide"
  MOD_RES (3)..(7): Any amino acid
  MOD_RES (9)..(12): Any amino acid
NVXXXXXCXXXXDVYGDGTA

SEQ ID NO: 19 - protein, 20 aa, Artificial Sequence
  source: /note="Description of Artificial Sequence: Synthetic peptide"
  MOD_RES (3)..(5): Any amino acid
  VARIANT (6)..(8): /replace="Ser" or "Asp" or "Gly" or "Tyr" or "Cys"
  MOD_RES (9)..(12): Any amino acid
  misc_feature (1)..(20): /note="Variant residues given in the sequence have no preference with respect to those in the annotations for variant positions"
NVXXXNNNXXXXDVYGGGTV

SEQ ID NO: 20 - protein, 20 aa, Artificial Sequence
  source: /note="Description of Artificial Sequence: Synthetic peptide"
  MOD_RES (3)..(5): Any amino acid
  VARIANT (6)..(8): /replace="Ser" or "Asp" or "Gly" or "Tyr" or "Cys"
  MOD_RES (9)..(12): Any amino acid
  misc_feature (1)..(20): /note="Variant residues given in the sequence have no preference with respect to those in the annotations for variant positions"
NVXXXNNNXXXXDVYGGGTA

SEQ ID NO: 21 - protein, 20 aa, Artificial Sequence
  source: /note="Description of Artificial Sequence: Synthetic peptide"
  MOD_RES (3)..(5): Any amino acid
  VARIANT (6)..(8): /replace="Ser" or "Asp" or "Gly" or "Tyr" or "Cys"
  MOD_RES (9)..(12): Any amino acid
  misc_feature (1)..(20): /note="Variant residues given in the sequence have no preference with respect to those in the annotations for variant positions"
NVXXXNNNXXXXDVYGDGTA

SEQ ID NO: 22 - protein, 21 aa, Artificial Sequence
  source: /note="Description of Artificial Sequence: Synthetic peptide"
  MOD_RES (3)..(9): Any amino acid
  MOD_RES (11)..(13): Any amino acid
NVXXXXXXXCXXXDVYGGGTV

SEQ ID NO: 23 - protein, 21 aa, Artificial Sequence
  source: /note="Description of Artificial Sequence: Synthetic peptide"
  MOD_RES (3)..(9): Any amino acid
  MOD_RES (11)..(13): Any amino acid
NVXXXXXXXCXXXDVYGGGTA

SEQ ID NO: 24 - protein, 21 aa, Artificial Sequence
  source: /note="Description of Artificial Sequence: Synthetic peptide"
  MOD_RES (3)..(9): Any amino acid
  MOD_RES (11)..(13): Any amino acid
NVXXXXXXXCXXXDVYGDGTA

SEQ ID NO: 25 - protein, 21 aa, Artificial Sequence
  source: /note="Description of Artificial Sequence: Synthetic peptide"
  MOD_RES (3)..(7): Any amino acid
  VARIANT (8)..(10): /replace="Ser" or "Asp" or "Gly" or "Tyr" or "Cys"
  MOD_RES (11)..(13): Any amino acid
  misc_feature (1)..(21): /note="Variant residues given in the sequence have no preference with respect to those in the annotations for variant positions"
NVXXXXXNNNXXXDVYGGGTV

SEQ ID NO: 26 - protein, 21 aa, Artificial Sequence
  source: /note="Description of Artificial Sequence: Synthetic peptide"
  MOD_RES (3)..(7): Any amino acid
  VARIANT (8)..(10): /replace="Ser" or "Asp" or "Gly" or "Tyr" or "Cys"
  MOD_RES (11)..(13): Any amino acid
  misc_feature (1)..(21): /note="Variant residues given in the sequence have no preference with respect to those in the annotations for variant positions"
NVXXXXXNNNXXXDVYGGGTA

SEQ ID NO: 27 - protein, 21 aa, Artificial Sequence
  source: /note="Description of Artificial Sequence: Synthetic peptide"
  MOD_RES (3)..(7): Any amino acid
  VARIANT (8)..(10): /replace="Ser" or "Asp" or "Gly" or "Tyr" or "Cys"
  MOD_RES (11)..(13): Any amino acid
  misc_feature (1)..(21): /note="Variant residues given in the sequence have no preference with respect to those in the annotations for variant positions"
NVXXXXXNNNXXXDVYGDGTA

SEQ ID NO: 28 - protein, 22 aa, Artificial Sequence
  source: /note="Description of Artificial Sequence: Synthetic peptide"
  MOD_RES (3)..(9): Any amino acid
  MOD_RES (11)..(14): Any amino acid
NVXXXXXXXCXXXXDVYGGGTV

SEQ ID NO: 29 - protein, 22 aa, Artificial Sequence
  source: /note="Description of Artificial Sequence: Synthetic peptide"
  MOD_RES (3)..(9): Any amino acid
  MOD_RES (11)..(14): Any amino acid
NVXXXXXXXCXXXXDVYGGGTA

SEQ ID NO: 30 - protein, 22 aa, Artificial Sequence
  source: /note="Description of Artificial Sequence: Synthetic peptide"
  MOD_RES (3)..(9): Any amino acid
  MOD_RES (11)..(14): Any amino acid
NVXXXXXXXCXXXXDVYGDGTA

SEQ ID NO: 31 - protein, 22 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(14): Any amino acid
  misc_feature (1)..(22): /note="Variant residues given in the sequence have no preference with respect to those in the annotations for variant positions"
NVXXXXXXNNNXXXDVYGGGTV

SEQ ID NO: 32 - protein, 22 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(14): Any amino acid
  misc_feature (1)..(22): /note="Variant residues given in the sequence have no preference with respect to those in the annotations for variant positions"
NVXXXXXXNNNXXXDVYGGGTA

SEQ ID NO: 33 - protein, 22 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(14): Any amino acid
  misc_feature (1)..(22): /note="Variant residues given in the sequence have no preference with respect to those in the annotations for variant positions"
NVXXXXXXNNNXXXDVYGDGTA

SEQ ID NO: 34 - protein, 22 aa, Artificial Sequence
  source: /note="Description of Artificial Sequence: Synthetic peptide"
  MOD_RES (3)..(9): Any amino acid
  MOD_RES (11)..(14): Any amino acid
NVXXXXXXXCXXXXDVYGGGTV

SEQ ID NO: 35 - protein, 22 aa, Artificial Sequence
  source: /note="Description of Artificial Sequence: Synthetic peptide"
  MOD_RES (3)..(9): Any amino acid
  MOD_RES (11)..(14): Any amino acid
NVXXXXXXXCXXXXDVYGGGTA

SEQ ID NO: 36 - protein, 22 aa, Artificial Sequence
  source: /note="Description of Artificial Sequence: Synthetic peptide"
  MOD_RES (3)..(9): Any amino acid
  MOD_RES (11)..(14): Any amino acid
NVXXXXXXXCXXXXDVYGDGTA

SEQ ID NO: 37 - protein, 23 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(15): Any amino acid
  misc_feature (1)..(23): /note="Variant residues given in the sequence have no preference with respect to those in the annotations for variant positions"
NVXXXXXXNNNXXXXDVYGGGTV

SEQ ID NO: 38 - protein, 23 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(15): Any amino acid
  misc_feature (1)..(23): /note="Variant residues given in the sequence have no preference with respect to those in the annotations for variant positions"
NVXXXXXXNNNXXXXDVYGGGTA

SEQ ID NO: 39 - protein, 23 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(15): Any amino acid
  misc_feature (1)..(23): /note="Variant residues given in the sequence have no preference with respect to those in the annotations for variant positions"
NVXXXXXXNNNXXXXDVYGDGTA

SEQ ID NO: 40 - protein, 24 aa, Artificial Sequence
  source: /note="Description of Artificial Sequence: Synthetic peptide"
  MOD_RES (3)..(9): Any amino acid
  MOD_RES (11)..(16): Any amino acid
KVXXXXXXXCXXXXXXDVYGGGTV

SEQ ID NO: 41 - protein, 24 aa, Artificial Sequence
  source: /note="Description of Artificial Sequence: Synthetic peptide"
  MOD_RES (3)..(9): Any amino acid
  MOD_RES (11)..(16): Any amino acid
KVXXXXXXXCXXXXXXDVYGGGTA

SEQ ID NO: 42 - protein, 24 aa, Artificial Sequence
  source: /note="Description of Artificial Sequence: Synthetic peptide"
  MOD_RES (3)..(9): Any amino acid
  MOD_RES (11)..(16): Any amino acid
KVXXXXXXXCXXXXXXDVYGDGTA

SEQ ID NO: 43 - protein, 24 aa, Artificial Sequence
  source: /note="Description of Artificial Sequence: Synthetic peptide"
  MOD_RES (3)..(5): Any amino acid
  VARIANT (6)..(6): /replace="Ser" or "Asp" or "Gly" or "Tyr" or "Cys"
  MOD_RES (7)..(7): Any amino acid
  VARIANT (8)..(8): /replace="Ser" or "Asp" or "Gly" or "Tyr" or "Cys"
  MOD_RES (9)..(9): Any amino acid
  VARIANT (10)..(10): /replace="Ser" or "Asp" or "Gly" or "Tyr" or "Cys"
  MOD_RES (11)..(16): Any amino acid
  misc_feature (1)..(24): /note="Variant residues given in the sequence have no preference with respect to those in the annotations for variant positions"
KVXXXNXNXNXXXXXXDVYGGGTV

SEQ ID NO: 44 - protein, 24 aa, Artificial Sequence
  source: /note="Description of Artificial Sequence: Synthetic peptide"
  MOD_RES (3)..(5): Any amino acid
  VARIANT (6)..(6): /replace="Ser" or "Asp" or "Gly" or "Tyr" or "Cys"
  MOD_RES (7)..(7): Any amino acid
  VARIANT (8)..(8): /replace="Ser" or "Asp" or "Gly" or "Tyr" or "Cys"
  MOD_RES (9)..(9): Any amino acid
  VARIANT (10)..(10): /replace="Ser" or "Asp" or "Gly" or "Tyr" or "Cys"
  MOD_RES (11)..(16): Any amino acid
  misc_feature (1)..(24): /note="Variant residues given in the sequence have no preference with respect to those in the annotations for variant positions"
KVXXXNXNXNXXXXXXDVYGGGTA

SEQ ID NO: 45 - protein, 24 aa, Artificial Sequence
  source: /note="Description of Artificial Sequence: Synthetic peptide"
  MOD_RES (3)..(5): Any amino acid
  VARIANT (6)..(6): /replace="Ser" or "Asp" or "Gly" or "Tyr" or "Cys"
  MOD_RES (7)..(7): Any amino acid
  VARIANT (8)..(8): /replace="Ser" or "Asp" or "Gly" or "Tyr" or "Cys"
  MOD_RES (9)..(9): Any amino acid
  VARIANT (10)..(10): /replace="Ser" or "Asp" or "Gly" or "Tyr" or "Cys"
  MOD_RES (11)..(16): Any amino acid
  misc_feature (1)..(24): /note="Variant residues given in the sequence have no preference with respect to those in the annotations for variant positions"
KVXXXNXNXNXXXXXXDVYGDGTA

SEQ ID NO: 46 - protein, 25 aa, Artificial Sequence
  source: /note="Description of Artificial Sequence: Synthetic peptide"
  MOD_RES (3)..(8): Any amino acid
  MOD_RES (10)..(17): Any amino acid
KVXXXXXXCXXXXXXXXDVYGGGTV

SEQ ID NO: 47 - protein, 25 aa, Artificial Sequence
  source: /note="Description of Artificial Sequence: Synthetic peptide"
  MOD_RES (3)..(8): Any amino acid
  MOD_RES (10)..(17): Any amino acid
KVXXXXXXCXXXXXXXXDVYGGGTA

SEQ ID NO: 48 - protein, 25 aa, Artificial Sequence
  source: /note="Description of Artificial Sequence: Synthetic peptide"
  MOD_RES (3)..(8): Any amino acid
  MOD_RES (10)..(17): Any amino acid
KVXXXXXXCXXXXXXXXDVYGDGTA

SEQ ID NO: 49 - protein, 25 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(17): Any amino acid
  misc_feature (1)..(25): /note="Variant residues given in the sequence have no preference with respect to those in the annotations for variant positions"
KVXXXXXXNNNXXXXXXDVYGGGTV

SEQ ID NO: 50 - protein, 25 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(17): Any amino acid
  misc_feature (1)..(25): /note="Variant residues given in the sequence have no preference with respect to those in the annotations for variant positions"
KVXXXXXXNNNXXXXXXDVYGGGTA

SEQ ID NO: 51 - protein, 25 aa, Artificial Sequence
  source: /note="Description of Artificial Sequence: Synthetic peptide"
  MOD_RES (3)..(8): Any amino acid
  VARIANT (9)..(11): /replace="Ser" or "Asp" or "Gly" or "Tyr" or "Cys"
  MOD_RES (12)..(17): Any amino acid
  misc_feature (1)..(25): /note="Variant residues given in the sequence have no preference with respect to those in the annotations for variant positions"
KVXXXXXXNNNXXXXXXDVYGDGTA

SEQ ID NO: 52 - protein, 26 aa, Artificial Sequence
  source: /note="Description of Artificial Sequence: Synthetic peptide"
  MOD_RES (3)..(12): Any amino acid
  MOD_RES (14)..(18): Any amino acid
KVXXXXXXXXXXCXXXXXDVYGGGTV

SEQ ID NO: 53 - protein, 26 aa, Artificial Sequence
  source: /note="Description of Artificial Sequence: Synthetic peptide"
  MOD_RES (3)..(12): Any amino acid
  MOD_RES (14)..(18): Any amino acid
KVXXXXXXXXXXCXXXXXDVYGGGTA

SEQ ID NO: 54 - protein, 26 aa, Artificial Sequence
  source: /note="Description of Artificial Sequence: Synthetic peptide"
  MOD_RES (3)..(12): Any amino acid
  MOD_RES (14)..(18): Any amino acid
KVXXXXXXXXXXCXXXXXDVYGDGTA

SEQ ID NO: 55 - protein, 26 aa, Artificial Sequence
  source: /note="Description of Artificial Sequence: Synthetic peptide"
  MOD_RES (3)..(10): Any amino acid
  VARIANT (11)..(13): /replace="Ser" or "Asp" or "Gly" or "Tyr" or "Cys"
  MOD_RES (14)..(18): Any amino acid
  misc_feature (1)..(26): /note="Variant residues given in the sequence have no preference with respect to those in the annotations for variant positions"
KVXXXXXXXXNNNXXXXXDVYGGGTV

SEQ ID NO: 56 - protein, 26 aa, Artificial Sequence
  source: /note="Description of Artificial Sequence: Synthetic peptide"
  MOD_RES (3)..(10): Any amino acid
  VARIANT (11)..(13): /replace="Ser" or "Asp" or "Gly" or "Tyr" or "Cys"
  MOD_RES (14)..(18): Any amino acid
  misc_feature (1)..(26): /note="Variant residues given in the sequence have no preference with respect to those in the annotations for variant positions"
KVXXXXXXXXNNNXXXXXDVYGGGTA

SEQ ID NO: 57 - protein, 26 aa, Artificial Sequence
  source: /note="Description of Artificial Sequence: Synthetic peptide"
  MOD_RES (3)..(10): Any amino acid
  VARIANT (11)..(13): /replace="Ser" or "Asp" or "Gly" or "Tyr" or "Cys"
  MOD_RES (14)..(18): Any amino acid
  misc_feature (1)..(26): /note="Variant residues given in the sequence have no preference with respect to those in the annotations for variant positions"
KVXXXXXXXXNNNXXXXXDVYGDGTA

SEQ ID NO: 58 - protein, 5 aa, Artificial Sequence
  source: /note="Description of Artificial Sequence: Synthetic peptide"
VTVNA

SEQ ID NO: 59 - protein, 32 aa, Artificial Sequence
  source: /note="Description of Artificial Sequence: Synthetic polypeptide"
  MOD_RES (2)..(11): Any amino acid
  MOD_RES (14)..(30): Any amino acid
CXXXXXXXXXXCDXXXXXXXXXXXXXXXXXAA

SEQ ID NO: 60 - protein, 26 aa, Artificial Sequence
  source: /note="Description of Artificial Sequence: Synthetic peptide"
  MOD_RES (1)..(9): Any amino acid
  MOD_RES (12)..(16): Any amino acid
  MOD_RES (18)..(24): Any amino acid
XXXXXXXXXCDXXXXXCXXXXXXXAA

SEQ ID NO: 61 - protein, 26 aa, Artificial Sequence
  source: /note="Description of Artificial Sequence: Synthetic peptide"
  MOD_RES (1)..(10): Any amino acid
  MOD_RES (13)..(19): Any amino acid
  MOD_RES (21)..(24): Any amino acid
XXXXXXXXXXCDXXXXXXXCXXXXAA

SEQ ID NO: 62 - DNA, 21 bp, Artificial Sequence
  source: /note="Description of Artificial Sequence: Synthetic oligonucleotide"
tacaaatgtggtgtacagcat

SEQ ID NO: 63 - DNA, 22 bp, Artificial Sequence
  source: /note="Description of Artificial Sequence: Synthetic oligonucleotide"
tagtacgacctgaaacattaac

SEQ ID NO: 64 - DNA, 47 bp, Artificial Sequence
  source: /note="Description of Artificial Sequence: Synthetic oligonucleotide"
gaggaggaggagaggcccaggcggccgctcgagtggaccaaacaccg

SEQ ID NO: 65 - DNA, 55 bp, Artificial Sequence
  source: /note="Description of Artificial Sequence: Synthetic oligonucleotide"
gaggaggaggaggaggcccctgaggccgcattcacagtcacgacagtgccacctc

SEQ ID NO: 66 - DNA, 55 bp, Artificial Sequence
  source: /note="Description of Artificial Sequence: Synthetic oligonucleotide"
gaggaggaggaggaggcccctgaggccgcattcacagtcacggcagtgccatctc

SEQ ID NO: 67 - DNA, 25 bp, Artificial Sequence
  source: /note="Description of Artificial Sequence: Synthetic oligonucleotide"
tcattaggcaccccaggctttacac

SEQ ID NO: 68 - DNA, 21 bp, Artificial Sequence
  source: /note="Description of Artificial Sequence: Synthetic oligonucleotide"
gcatcgatacgtgccactgtc

SEQ ID NO: 69 - DNA, 25 bp, Artificial Sequence
  source: /note="Description of Artificial Sequence: Synthetic oligonucleotide"
attaaagccagaatggaaagcgcag

SEQ ID NO: 70 - DNA, 96 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
gacagtggcacgtatcgatgcaacgtannknnknnknnktgcnnknnknnknnkgatgtatacggaggtggcactgtcgtgactgtgaatgcggcc

SEQ ID NO: 71 - DNA, 96 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
gacagtggcacgtatcgatgcaacgtannknnknnknnktgcnnknnknnknnkgatgtatacggaggtggcactgccgtgactgtgaatgcggcc

SEQ ID NO: 72 - DNA, 96 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
gacagtggcacgtatcgatgcaacgtannknnknnknnktgcnnknnknnknnkgatgtatacggagatggcactgccgtgactgtgaatgcggcc

SEQ ID NO: 73 - DNA, 96 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
gacagtggcacgtatcgatgcaacgtannknnknnkdrydrydrynnknnknnkgatgtatacggaggtggcactgtcgtgactgtgaatgcggcc

SEQ ID NO: 74 - DNA, 96 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
gacagtggcacgtatcgatgcaacgtannknnknnkdrydrydrynnknnknnkgatgtatacggaggtggcactgccgtgactgtgaatgcggcc

SEQ ID NO: 75 - DNA, 96 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
gacagtggcacgtatcgatgcaacgtannknnknnkdrydrydrynnknnknnkgatgtatacggagatggcactgccgtgactgtgaatgcggcc

SEQ ID NO: 76 - DNA, 99 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
gacagtggcacgtatcgatgcaacgtannknnknnknnknnktgcnnknnknnknnkgatgtatacggaggtggcactgtcgtgactgtgaatgcggcc

SEQ ID NO: 77 - DNA, 99 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
gacagtggcacgtatcgatgcaacgtannknnknnknnknnktgcnnknnknnknnkgatgtatacggaggtggcactgccgtgactgtgaatgcggcc

SEQ ID NO: 78 - DNA, 99 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
gacagtggcacgtatcgatgcaacgtannknnknnknnknnktgcnnknnknnknnkgatgtatacggagatggcactgccgtgactgtgaatgcggcc

SEQ ID NO: 79 - DNA, 99 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
gacagtggcacgtatcgatgcaacgtannknnknnkdrydrydrynnknnknnknnkgatgtatacggaggtggcactgtcgtgactgtgaatgcggcc

SEQ ID NO: 80 - DNA, 99 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
gacagtggcacgtatcgatgcaacgtannknnknnkdrydrydrynnknnknnknnkgatgtatacggaggtggcactgccgtgactgtgaatgcggcc

SEQ ID NO: 81 - DNA, 99 bp, Artificial Sequence
  source: /note="Description of Artificial Sequence: Synthetic oligonucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
gacagtggcacgtatcgatgcaacgtannknnknnkdrydrydrynnknnknnknnkgatgtatacggagatggcactgccgtgactgtgaatgcggcc

SEQ ID NO: 82 - DNA, 102 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
gacagtggcacgtatcgatgcaacgtannknnknnknnknnknnknnktgcnnknnknnkgatgtatacggaggtggcactgtcgtgactgtgaatgcggcc

SEQ ID NO: 83 - DNA, 102 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
gacagtggcacgtatcgatgcaacgtannknnknnknnknnknnknnktgcnnknnknnkgatgtatacggaggtggcactgccgtgactgtgaatgcggcc

SEQ ID NO: 84 - DNA, 102 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
gacagtggcacgtatcgatgcaacgtannknnknnknnknnknnknnktgcnnknnknnkgatgtatacggagatggcactgccgtgactgtgaatgcggcc

SEQ ID NO: 85 - DNA, 102 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
gacagtggcacgtatcgatgcaacgtannknnknnknnknnkdrydrydrynnknnknnkgatgtatacggaggtggcactgtcgtgactgtgaatgcggcc

SEQ ID NO: 86 - DNA, 102 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
gacagtggcacgtatcgatgcaacgtannknnknnknnknnkdrydrydrynnknnknnkgatgtatacggaggtggcactgccgtgactgtgaatgcggcc

SEQ ID NO: 87 - DNA, 102 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
gacagtggcacgtatcgatgcaacgtannknnknnknnknnkdrydrydrynnknnknnkgatgtatacggagatggcactgccgtgactgtgaatgcggcc

SEQ ID NO: 88 - DNA, 105 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
gacagtggcacgtatcgatgcaacgtannknnknnknnknnknnknnktgcnnknnknnknnkgatgtatacggaggtggcactgtcgtgactgtgaatgcggcc

SEQ ID NO: 89 - DNA, 105 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
gacagtggcacgtatcgatgcaacgtannknnknnknnknnknnknnktgcnnknnknnknnkgatgtatacggaggtggcactgccgtgactgtgaatgcggcc

SEQ ID NO: 90 - DNA, 105 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
gacagtggcacgtatcgatgcaacgtannknnknnknnknnknnknnktgcnnknnknnknnkgatgtatacggagatggcactgccgtgactgtgaatgcggcc

SEQ ID NO: 91 - DNA, 105 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
gacagtggcacgtatcgatgcaacgtannknnknnknnknnknnkdrydrydrynnknnknnkgatgtatacggaggtggcactgtcgtgactgtgaatgcggcc

SEQ ID NO: 92 - DNA, 105 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
gacagtggcacgtatcgatgcaacgtannknnknnknnknnknnkdrydrydrynnknnknnkgatgtatacggaggtggcactgccgtgactgtgaatgcggcc

SEQ ID NO: 93 - DNA, 105 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
gacagtggcacgtatcgatgcaacgtannknnknnknnknnknnkdrydrydrynnknnknnkgatgtatacggagatggcactgccgtgactgtgaatgcggcc

SEQ ID NO: 94 - DNA, 108 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
gacagtggcacgtatcgatgcaacgtannknnknnknnknnknnknnktgcnnknnknnknnknnkgatgtatacggaggtggcactgtcgtgactgtgaatgcggcc

SEQ ID NO: 95 - DNA, 108 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
gacagtggcacgtatcgatgcaacgtannknnknnknnknnknnknnktgcnnknnknnknnknnkgatgtatacggaggtggcactgccgtgactgtgaatgcggcc

SEQ ID NO: 96 - DNA, 108 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
gacagtggcacgtatcgatgcaacgtannknnknnknnknnknnknnktgcnnknnknnknnknnkgatgtatacggagatggcactgccgtgactgtgaatgcggcc

SEQ ID NO: 97 - DNA, 108 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
gacagtggcacgtatcgatgcaacgtannknnknnknnknnknnkdrydrydrynnknnknnknnkgatgtatacggaggtggcactgtcgtgactgtgaatgcggcc

SEQ ID NO: 98 - DNA, 108 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
gacagtggcacgtatcgatgcaacgtannknnknnknnknnknnkdrydrydrynnknnknnknnkgatgtatacggaggtggcactgccgtgactgtgaatgcggcc

SEQ ID NO: 99 - DNA, 108 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
gacagtggcacgtatcgatgcaacgtannknnknnknnknnknnkdrydrydrynnknnknnknnkgatgtatacggagatggcactgccgtgactgtgaatgcggcc

SEQ ID NO: 100 - DNA, 111 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
gacagtggcacgtatcgatgcaaggtannknnknnknnknnknnknnktgcnnknnknnknnknnknnkgatgtatacggaggtggcactgtcgtgactgtgaatgcggcc

SEQ ID NO: 101 - DNA, 111 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
gacagtggcacgtatcgatgcaaggtannknnknnknnknnknnknnktgcnnknnknnknnknnknnkgatgtatacggaggtggcactgccgtgactgtgaatgcggcc

SEQ ID NO: 102 - DNA, 111 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
gacagtggcacgtatcgatgcaaggtannknnknnknnknnknnknnktgcnnknnknnknnknnknnkgatgtatacggagatggcactgccgtgactgtgaatgcggcc

SEQ ID NO: 103 - DNA, 111 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (40)..(41): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
gacagtggcacgtatcgatgcaaggtannknnknnkdrynnkdrynnkdrynnknnknnknnknnknnkgatgtatacggaggtggcactgtcgtgactgtgaatgcggcc

SEQ ID NO: 104 - DNA, 111 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (40)..(41): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
gacagtggcacgtatcgatgcaaggtannknnknnkdrynnkdrynnkdrynnknnknnknnknnknnkgatgtatacggaggtggcactgccgtgactgtgaatgcggcc

SEQ ID NO: 105 - DNA, 111 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (40)..(41): a, c, t, g, unknown or other
  modified_base (46)..(47): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
gacagtggcacgtatcgatgcaaggtannknnknnkdrynnkdrynnkdrynnknnknnknnknnknnkgatgtatacggagatggcactgccgtgactgtgaatgcggcc

SEQ ID NO: 106 - DNA, 114 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
gacagtggcacgtatcgatgcaaggtannknnknnknnknnknnktgcnnknnknnknnknnknnknnknnkgatgtatacggaggtggcactgtcgtgactgtgaatgcggcc

SEQ ID NO: 107 - DNA, 114 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
gacagtggcacgtatcgatgcaaggtannknnknnknnknnknnktgcnnknnknnknnknnknnknnknnkgatgtatacggaggtggcactgccgtgactgtgaatgcggcc

SEQ ID NO: 108 - DNA, 114 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
gacagtggcacgtatcgatgcaaggtannknnknnknnknnknnktgcnnknnknnknnknnknnknnknnkgatgtatacggagatggcactgccgtgactgtgaatgcggcc

SEQ ID NO: 109 - DNA, 114 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
gacagtggcacgtatcgatgcaaggtannknnknnknnknnknnkdrydrydrynnknnknnknnknnknnkgatgtatacggaggtggcactgtcgtgactgtgaatgcggcc

SEQ ID NO: 110 - DNA, 114 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
gacagtggcacgtatcgatgcaaggtannknnknnknnknnknnkdrydrydrynnknnknnknnknnknnkgatgtatacggaggtggcactgccgtgactgtgaatgcggcc

SEQ ID NO: 111 - DNA, 114 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (55)..(56): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
gacagtggcacgtatcgatgcaaggtannknnknnknnknnknnkdrydrydrynnknnknnknnknnknnkgatgtatacggagatggcactgccgtgactgtgaatgcggcc

SEQ ID NO: 112 - DNA, 117 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
gacagtggcacgtatcgatgcaaggtannknnknnknnknnknnknnknnknnknnktgcnnknnknnknnknnkgatgtatacggaggtggcactgtcgtgactgtgaatgcggcc

SEQ ID NO: 113 - DNA, 117 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
gacagtggcacgtatcgatgcaaggtannknnknnknnknnknnknnknnknnknnktgcnnknnknnknnknnkgatgtatacggaggtggcactgccgtgactgtgaatgcggcc

SEQ ID NO: 114 - DNA, 117 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
gacagtggcacgtatcgatgcaaggtannknnknnknnknnknnknnknnknnknnktgcnnknnknnknnknnkgatgtatacggagatggcactgccgtgactgtgaatgcggcc

SEQ ID NO: 115 - DNA, 117 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
gacagtggcacgtatcgatgcaaggtannknnknnknnknnknnknnknnkdrydrydrynnknnknnknnknnkgatgtatacggaggtggcactgtcgtgactgtgaatgcggcc

SEQ ID NO: 116 - DNA, 117 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
gacagtggcacgtatcgatgcaaggtannknnknnknnknnknnknnknnkdrydrydrynnknnknnknnknnkgatgtatacggaggtggcactgccgtgactgtgaatgcggcc

SEQ ID NO: 117 - DNA, 117 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
gacagtggcacgtatcgatgcaaggtannknnknnknnknnknnknnknnkdrydrydrynnknnknnknnknnkgatgtatacggagatggcactgccgtgactgtgaatgcggcc

SEQ ID NO: 118 - DNA, 135 bp, Artificial Sequence
  source: /note="Description of Artificial Sequence: Synthetic polynucleotide"
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (55)..(56): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
  modified_base (76)..(77): a, c, t, g, unknown or other
  modified_base (79)..(80): a, c, t, g, unknown or other
  modified_base (82)..(83): a, c, t, g, unknown or other
  modified_base (85)..(86): a, c, t, g, unknown or other
  modified_base (88)..(89): a, c, t, g, unknown or other
  modified_base (91)..(92): a, c, t, g, unknown or other
  modified_base (94)..(95): a, c, t, g, unknown or other
  modified_base (97)..(98): a, c, t, g, unknown or other
  modified_base (100)..(101): a, c, t, g, unknown or other
  modified_base (103)..(104): a, c, t, g, unknown or other
  modified_base (106)..(107): a, c, t, g, unknown or other
  modified_base (109)..(110): a, c, t, g, unknown or other
  modified_base (112)..(113): a, c, t, g, unknown or other
ggtggcacgtatcgttgcggtgtctgcnnknnknnknnknnknnknnknnknnknnktgtgatnnknnknnknnknnknnknnknnknnknnknnknnknnknnknnknnknnkgctgcatgcggagatggcact

SEQ ID NO: 119 - DNA, 117 bp, Artificial Sequence
  source: /note="Description of Artificial Sequence: Synthetic polynucleotide"
  modified_base (25)..(26): a, c, t, g, unknown or other
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (58)..(59): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (76)..(77): a, c, t, g, unknown or other
  modified_base (79)..(80): a, c, t, g, unknown or other
  modified_base (82)..(83): a, c, t, g, unknown or other
  modified_base (85)..(86): a, c, t, g, unknown or other
  modified_base (88)..(89): a, c, t, g, unknown or other
  modified_base (91)..(92): a, c, t, g, unknown or other
  modified_base (94)..(95): a, c, t, g, unknown or other
ggtggcacgtatcgttgcggtgccnnknnknnknnknnknnknnknnknnktgtgacnnknnknnknnknnktgtnnknnknnknnknnknnknnkgctgcatgcggagatggcact

SEQ ID NO: 120 - DNA, 117 bp, Artificial Sequence
  source: /note="Description of Artificial Sequence: Synthetic polynucleotide"
  modified_base (25)..(26): a, c, t, g, unknown or other
  modified_base (28)..(29): a, c, t, g, unknown or other
  modified_base (31)..(32): a, c, t, g, unknown or other
  modified_base (34)..(35): a, c, t, g, unknown or other
  modified_base (37)..(38): a, c, t, g, unknown or other
  modified_base (40)..(41): a, c, t, g, unknown or other
  modified_base (43)..(44): a, c, t, g, unknown or other
  modified_base (46)..(47): a, c, t, g, unknown or other
  modified_base (49)..(50): a, c, t, g, unknown or other
  modified_base (52)..(53): a, c, t, g, unknown or other
  modified_base (61)..(62): a, c, t, g, unknown or other
  modified_base (64)..(65): a, c, t, g, unknown or other
  modified_base (67)..(68): a, c, t, g, unknown or other
  modified_base (70)..(71): a, c, t, g, unknown or other
  modified_base (73)..(74): a, c, t, g, unknown or other
  modified_base (76)..(77): a, c, t, g, unknown or other
  modified_base (79)..(80): a, c, t, g, unknown or other
  modified_base (85)..(86): a, c, t, g, unknown or other
  modified_base (88)..(89): a, c, t, g, unknown or other
  modified_base (91)..(92): a, c, t, g, unknown or other
  modified_base (94)..(95): a, c, t, g, unknown or other
ggtggcacgtatcgttgcggtgtcnnknnknnknnknnknnknnknnknnknnktgtgacnnknnknnknnknnknnknnktgcnnknnknnknnkgctgcatgcggagatggcact

SEQ ID NO: 121 - DNA, 21 bp, Artificial Sequence
  source: /note="Description of Artificial Sequence: Synthetic oligonucleotide"
accgcaacgatacgtgccacc

SEQ ID NO: 122 - DNA, 39 bp, Artificial Sequence
  source: /note="Description of Artificial Sequence: Synthetic oligonucleotide"
agccggccatggcccaggcggccctggtgcagtctggag

SEQ ID NO: 123 - DNA, 39 bp, Artificial Sequence
  source: /note="Description of Artificial Sequence: Synthetic oligonucleotide"
ctccagactgcaccagggccgcctgggccatggccggct

SEQ ID NO: 124 - DNA, 71 bp, Artificial Sequence
  source: /note="Description of Artificial Sequence: Synthetic oligonucleotide"
ggccgcggcctcaggggcccaccatcaccatcaccatggcgcagactacaaggacgacgacgacaagtagg

SEQ ID NO: 125 - DNA, 71 bp, Artificial Sequence
  source: /note="Description of Artificial Sequence: Synthetic oligonucleotide"
gatccctacttgtcgtcgtcgtccttgtagtctgcgccatggtgatggtgatggtgggcccctgaggccgc

SEQ ID NO: 126 - protein, 5 aa, Artificial Sequence
  source: /note="Description of Artificial Sequence: Synthetic peptide"
GGGGS

SEQ ID NO: 127 - protein, 103 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYDQCVDVYGGGTAVTVNA

SEQ ID NO: 128 - protein, 104 aa, Artificial Sequence
  source: /note="Description of Artificial Sequence: Synthetic polypeptide"
ARVDQTPQTITKETGESLTINCVLRDSNCALSSTSWYRKQSGSTNEETISKGGRYVETVNSGSKSFSLRINDLTVEDSGTYRCTGRGRDLCTGNGGGTAVTVNA

SEQ ID NO: 129 - protein, 104 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRITDLTVEDSGTYRCNVYDSCWSWVYGGGTVVTVNA

SEQ ID NO: 130 - protein, 105 aa, Artificial Sequence
  source: /note="Description of Artificial Sequence: Synthetic polypeptide"
ARVDQTPQTITKETGESLTINCVLRDSNCALSSTYWYRKKSGSTNEESISKSGRYVETVNSGSKSFSLRINDLTVEDSGTYRCNAYGCPGDLGLYGGGTVVTVNA

SEQ ID NO: 131 - protein, 105 aa, Artificial Sequence
  source: /note="Description of Artificial Sequence: Synthetic polypeptide"
ARVDQTPQTITKETGESLTINCVLRDSVCALSSTYWYRKKSGSTNEESISKGGRYVETVNSGSKSFSLRINDLTVEDSGTYRCNVEGYCIVYDVGGGGTAVTVNA

SEQ ID NO: 132 - protein, 105 aa, Artificial Sequence
  source: /note="Description of Artificial Sequence: Synthetic polypeptide"
ARVDQTPQTITKETGESLTINCVLRDTNCALSRTYWNHKKSGSTNWEIISKGGRYVETVNSGSKSFSLRINDLTVEDSGTYRCKPLVCKQGWALYGGGTVVTVNA

SEQ ID NO: 133 - protein, 104 aa, Artificial Sequence
  source: /note="Description of Artificial Sequence: Synthetic polypeptide"
ARVDQTPQTITKETGESLTINCVLLESTCAVVGTYWYRKKSGSTNEESISKGGRYETFKSGSKSFSLRINDLTVEDSGTYRCKSLRCSAGYPDYGDGTAVTVNA

SEQ ID NO: 134 - protein, 105 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVFCMTAPSDVYGGGTVVTVNA

SEQ ID NO: 135 - protein, 105 aa, Artificial Sequence
  source: /note="Description of Artificial Sequence: Synthetic polypeptide"
ARVDQTPQTITKETGESLTINCALLGSNCVFSSTYWYRGKSGSTNEESITKGGRYVETVNSGSKSFQLRINDLTVEDSGTYRCKAWICREGYERYGGGTAVTVNA

SEQ ID NO: 136 - protein, 105 aa, Artificial Sequence
  source: /note="Description of Artificial Sequence: Synthetic polypeptide"
ARVDQTPQTITKETGESLTINCVLSASTCILTETLWLRNQSGSTNEETISLGGRYSETVNRGRKSFSLRINDLTVEDSGNYRCLGKRCSAKFETYGGGTVVTVNA

SEQ ID NO: 137 - protein, 106 aa, Artificial Sequence
  source: /note="Description of Artificial Sequence: Synthetic polypeptide"
ARVDQTPQTITKETGESLTINCVLRDANCALASTYWYRKKSGSTNEESISKGGRYVETVNSGSKSFSLRINDLTVEDSGTYRCKWATPNCRGYDVYGGGTAVTVNA

SEQ ID NO: 138 - protein, 106 aa, Artificial Sequence
  source: /note="Description of Artificial Sequence: Synthetic polypeptide"
ARVDQKPQTITKETGESLTINCVLRDSNCALSSTYWYRKKSGSTNEESISKGGRYVETVNSGSKSFSLRINDLTVEDSGTYRCNVWAGCYPPDDVYGGGTAVTVNA

SEQ ID NO: 139 - protein, 106 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVPWDCGNWRDVYGGGTVVTVNA

SEQ ID NO: 140 - protein, 106 aa, Artificial Sequence
  source: /note="Description of Artificial Sequence: Synthetic polypeptide"
ARVDQTPQTITKETGESLTINCVLRDSNCELSSTYWYRKKSGSTNEESISKGGRYVETVNSRSKSFSLRINDLRVEDSGTYRCNTHSCRLWTADVYGGGTVVTVNA

SEQ ID NO: 141 - protein, 106 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKTRCYSSRFVDVYGGGTVVTVNA

SEQ ID NO: 142 - protein, 106 aa, Artificial Sequence
  source: /note="Description of Artificial Sequence: Synthetic polypeptide"
ARVDQTPQTITKETGESLTINCVLRDRPCGLSSTYWYRQKSGSTNEESISKGGRYVETVNSGSKSFSLRINDLTVEDSGTYRCVVYRVCRVTVPVYGGGTVVTVNA

SEQ ID NO: 143 - protein, 108 aa, Artificial Sequence
  source: /note="Description of Artificial Sequence: Synthetic polypeptide"
ARVDQTPQTITKETGESLTINCVLRDSICALSSTDWLRKKSDYTNEENISKGGRYVETVNSGSKSSSLRINDLTVEDSGTYRCKVYCPDRQNWGRDVYGGGTVVTVNA

SEQ ID NO: 144 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWADSCPGELGRYGDGTAVTVNA

SEQ ID NO: 145 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVLDGGTYRCNVNSWSCELAYNVYGGGTVVTVNA

SEQ ID NO: 146 - protein, 107 aa, Artificial Sequence
  source: /note="Description of Artificial Sequence: Synthetic polypeptide"
ARVDQTPQTITKETGESLTINCVLRDSNCALSNTYWYRKKSGSTNEESILKGGRYVETVNSGSKSFSLRINDLTVEDSGTYRCNGVSWYGSCNDDVYGDGTAVTVNA

SEQ ID NO: 147 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNTSWFSYDCELDVYGGGTVVTVNA

SEQ ID NO: 148 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVERCRLNWSYDVYGGGTAVTVNA

SEQ ID NO: 149 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNCPLVCRGYNYDVYGGGTVVTVNA

SEQ ID NO: 150 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNGACYQNWRHYDVYGDGTAVTVNA

SEQ ID NO: 151 - protein, 107 aa, Artificial Sequence
  source: /note="Description of Artificial Sequence: Synthetic polypeptide"
ARVDQTPQTITKETGESLTINCVLRDSNCALSSTYWYRKNSGSRNEESISLGGRYVETVNSGSKSFSLRINDLTVEDSGTYGCNANSWSCEMAYNVYGGGTVVTVNA

SEQ ID NO: 152 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCRSWYGDDCRTGGASGGGTAVTVNA

SEQ ID NO: 153 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKELVHRVLEGCDVYGGGTAVTVNA

SEQ ID NO: 154 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVFETDCPMNWRVYGGGTAVTVNA

SEQ ID NO: 155 - protein, 107 aa, Artificial Sequence
  source: /note="Description of Artificial Sequence: Synthetic polypeptide"
ARVDQTPQTITKETGESLTINCVLRDTNCALSYTYWYRKKSGSRNEENIWKGGRYVETVNSGSKSFSLNINDLTVEDSGAYRCNAHNWDCELAYNVYGGGTVVTVNA

SEQ ID NO: 156 - protein, 107 aa, Artificial Sequence
  source: /note="Description of Artificial Sequence: Synthetic polypeptide"
ARVDQTPQTITKETGESVTINCVARDSNCALSATHWYRKKSGSTNEENILKGGRYVETVNSGSKSFSLRINDLTVEDSGTYRCNLRETWPCWSPDVYGGGTVVTVNA

SEQ ID NO: 157 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVFLLGLICTDDVYGGGTVVTVNA

SEQ ID NO: 158 - protein, 107 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRCNGKLVWLYDCPDVYGDGTAVTVNA

SEQ ID NO: 159 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCSTRCYTRTGPYDVYGDGTAVTVNA

SEQ ID NO: 160 - protein, 107 aa, Artificial Sequence
  source: /note="Description of Artificial Sequence: Synthetic polypeptide"
ARVDQTPQTITKETGESLTINCVLRDTNCALSSTYWYRKKSGSTDEESISKGGRYVETVNSGSKSFSLRINDLSVEDSGTYGCKAGRDCSLYKDDKYGDGTAVTVNA

SEQ ID NO: 161 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCPYCRVAMTGVPDVYGGGTVVTVNA

SEQ ID NO: 162 - protein, 107 aa, Artificial Sequence
  source: /note="Description of Artificial Sequence: Synthetic polypeptide"
ARVDQTPQTITKETGESLTINCVLRDGNCALSNTFWYRKKSGSTNEDSISIGGRYFETVKRGSKSLSLRINDLTVEDSGTYRCKYPGDSWRCTYDIYGDGTAVTVNA

SEQ ID NO: 163 - protein, 107 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNWYQSCGGWGNDVYGGGTVVTVNA

SEQ ID NO: 164 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVGCPNWDPQYYDVYGDGTAVTVNA

SEQ ID NO: 165 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYLCGLERYNYDVYGGGTVVTVNA

SEQ ID NO: 166 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWVIAGIGCNYDVYGGGTVVTVNA

SEQ ID NO: 167 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNALYSWAECAGLDEYGGGTAVTVNA

SEQ ID NO: 168 - protein, 108 aa, Artificial Sequence
  source: /note="Description of Artificial Sequence: Synthetic polypeptide"
ARVDQTPRSVTKETGESLTINCVLRDSNCALSSTYWYRKKSGSTNEESISKGGRYVETVNSGSKSFSLRINDLTVEDSGTYRCNVLLCLVLNSNYDVYGDGTAVTVNA

SEQ ID NO: 169 - protein, 108 aa, Artificial Sequence
  source: /note="Description of Artificial Sequence: Synthetic polypeptide"
ARVDQTPQTITKETGESLTINCVARDSNCALSRTYWYRKKSGSTNEESISKGGRYVETVNSGSKSFSLRINDLTVEDSGTYRCNAWYRPDCELDYDVYGGGTAVTVNA

SEQ ID NO: 170 - protein, 108 aa, Artificial Sequence
  source: /note="Description of Artificial Sequence: Synthetic polypeptide"
ARVDQTPQTITKETGESLTINCVARDSNCALSRTYWYRKKSGSTNEESISKGGRYVETVNSGSKSFSLRINDLTVEDSGTYRCNVADWSCAMNWRGVYGDGTAVTVNA

SEQ ID NO: 171 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVLDTDCGAGPPDVYGGGTVVTVNA

SEQ ID NO: 172 - protein, 108 aa, Artificial Sequence
  source: /note="Description of Artificial Sequence: Synthetic polypeptide"
ARVDQTPQTITKETGESLTINCVARDSNCALSRTYWYRKKSGSTNEESISKGGRYVETVNSGSKSFSLRINDLTVEDSGTYRCNPIRSYDCAWIYDVYGDGTAVTVNA

SEQ ID NO: 173 - protein, 108 aa, Artificial Sequence
  source: /note="Description of Artificial Sequence: Synthetic polypeptide"
ARVDQTPQTITKETGESLTINCVARDSNCALSRTYWYRKKSGSTNEESISKGGRYVETVNSGSKSFFLRINDLTVEDSGTYRCNAWYRPDCELDYDVYGGGTAVTVNA

SEQ ID NO: 174 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVRSWYDDCGGDYVYGGGTAVTVNA

SEQ ID NO: 175 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKGGPGWGCLGGYDVYGGGTVVTVNA

SEQ ID NO: 176 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKSVCWSDMTAGDDVYGGGTVVTVNA

SEQ ID NO: 177 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVRGVCFGLEMHDVYGDGTAVTVNA

SEQ ID NO: 178 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVLCWPYARGERDVYGGGTVVTVNA

SEQ ID NO: 179 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVLLLCSTNWNYDVYGGGTVVTVNA

SEQ ID NO: 180 - protein, 108 aa, Artificial Sequence
  source: /note="Description of Artificial Sequence: Synthetic polypeptide"
ARVDQTPQTITKETGESLTINCVLRDSNCDLSRTYWYRKKSSSTNEESISKGGRYVETVNSGSKSFSLRINDLVVEDSGTYRCNVYGMSIYGNWCDVNGGGTAVTVNA

SEQ ID NO: 181 - protein, 108 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLVVEDSGTYRCNVYGMSIYGNWCDVNGGGTVVTVNA

SEQ ID NO: 182 - protein, 108 aa, Artificial Sequence
  source: /note="Description of Artificial Sequence: Synthetic polypeptide"
ARVDQTPRTITKETGESLTINCVLRDSNCYWDSTWWYRKNTERRDWEDIDKGGRYVETVNSGSKYLSLRINDLIIEDSGTLRCKILCVGDAGQWMDLYGGGTVVTVNA

SEQ ID NO: 183 - protein, 108 aa, Artificial Sequence
  source: /note="Description of Artificial Sequence: Synthetic polypeptide"
ARVDQTPQTITKETGESLTINCALRRSNCALYSTYWYRKKSGSTDEENISKDGRYVETVNSGSKSFSLRINDLTVEDSGTYRCNTLVWDCLDLDRDVYGGGTVVTVNA

SEQ ID NO: 184 - protein, 108 aa, Artificial Sequence
  source: /note="Description of Artificial Sequence: Synthetic polypeptide"
ARVDQTPQTITKETGESLTINCVLRDSNCALSKTYWYRTKSGSTNEERISKGGRYIETVNSGSKSFSLRINDLTVEDSGTYRCNVVSCRWTATAYDVYGDGTAVTVNA

SEQ ID NO: 185 - protein, 108 aa, Artificial Sequence
  source: /note="Description of Artificial Sequence: Synthetic polypeptide"
ARVDQTPQTITKETGESLTINCVLRDSNCALSNTYWYRKKSGSINEESISKGGRYVETVNSGSKSFSLRINDLTVEDSGTYRCNAGIRGYDCGWPDVYGDGTAVTVNA

SEQ ID NO: 186 - protein, 108 aa, Artificial Sequence; identical to SEQ ID NO: 169
  source: /note="Description of Artificial Sequence: Synthetic polypeptide"

SEQ ID NO: 187 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRIYDLTVEDSGTYRCKETVWCLTGFELDVYGGGTVVTVNA

SEQ ID NO: 188 - protein, 108 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWLVCGYGSGVDVYGGGTAVTVNA

SEQ ID NO: 189 - protein, 109 aa, Artificial Sequence
  source: /note="Description of Artificial Sequence: Synthetic polypeptide"
ARVDQTPQTITKETGESLTINCVLRDNNCALLSTYWYRIKSGSTNEGEISKGGRYVETSNSGSKSLSLRINDLTVEDSGTYRCKMVGYRPIGSGICDVYGGGTVVTVNA

SEQ ID NO: 190 - protein, 109 aa, Artificial Sequence
  source: /note="Description of Artificial Sequence: Synthetic polypeptide"
ARVDQTPQTITKETGESLTINCVLRDSNCALHRTYWYRKKSGSTNEESISKGGRYVETVNSGSKSFSLRINDLTVEDSGTYRCNVYAGMIGYPNWCDVYGGGTAVTVNA

SEQ ID NO: 191 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVHPGLWLECDNYDVYGGGTAVTVNA

SEQ ID NO: 192 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLRINDLTVEDSGTYRCNVYPTWSDDCLNRDVYGDGTAVTVNA

SEQ ID NO: 193 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYSWSDLCRELVGVYGGGTVVTVNA

SEQ ID NO: 194 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNGQLVWCAMQLGDDVYGGGTAVTVNA

SEQ ID NO: 195 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVHWYCIARNWIGDVYGGGTAVTVNA

SEQ ID NO: 196 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNYWLYDCGNWDTYDVYGDGTAVTVNA

SEQ ID NO: 197 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYSWYTRACGELDVYGGGTVVTVNA

SEQ ID NO: 198 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYPPDCTTNWSPDVYGGGTVVTVNA

SEQ ID NO: 199 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKSEPAALWCWAIDDVYGDGTAVTVNA

SEQ ID NO: 200 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKNNSGIAISLNCPDVYGGGTVVTVNA

SEQ ID NO: 201 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVYPSWYGGLDCADVYGGGTVVTVNA

SEQ ID NO: 202 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCMTWYGNDCGAMNRDVYGGGTVVTVNA

SEQ ID NO: 203 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVFRDCASGPDGYDVYGGGTVVTVNA

SEQ ID NO: 204 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVRVWYNDCRTGTQKYGGGTVVTVNA

SEQ ID NO: 205 - protein, 109 aa, Artificial Sequence
  source: /note="Description of Artificial Sequence: Synthetic polypeptide"
ARVDQTPQTITKETGESLTINCVLRDNNCALSSTYWYRKKSGSSHEESISKGGRYVETVNSGSKSFSLRINDLTIEDSGTFRCKVRKAGMNPVCLLAVHGGGTAVTVNA

SEQ ID NO: 206 - protein, 109 aa, Artificial Sequence
  source: /note="Description of Artificial Sequence: Synthetic polypeptide"
ARVDQTPQTITKETGESLTINCVLRDSNCALSSTYWYRKKSGSTSEESISKGGRYVETVNSGSKSFSLRINDLTVEDSGTYRCKASWYTRRMLLCGDVYGGGTVVTVNA

SEQ ID NO: 207 - protein, 109 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCKAQQGGLCWGSKSDVYGGGTVVTVNA

SEQ ID NO: 208 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYQAGMGPCRTGDVYGGGTAVTVNA

SEQ ID NO: 209 - protein, 109 aa, Artificial Sequence
  source: /note="Description of Artificial Sequence: Synthetic polypeptide"
ARVDQTPCTITKETGESLTINCVLHRSRCALSATYWYRKKSGSTNEETISKGGRFVETVNRTSKSFSLRINDLTVEDSGTYRCKPADAGVDIFRDCEIFGDGTAVTVNA

SEQ ID NO: 210 - protein, 110 aa, Artificial Sequence
  source: /note="Description of Artificial Sequence: Synthetic polypeptide"
ARVDQTPQTITKETGESLTINCVLRDCSGALSDTWWYRKKSGSTKEELISEGGRYVDTAWLHAKSWFLRINDLVVEDSGTYRCKGRCRRVDGMAIELDFYGGGTAVTVNA

SEQ ID NO: 211 - protein, 110 aa, Artificial Sequence
  source: /note="Description of Artificial Sequence: Synthetic polypeptide"
ARVDQTPQTITKETGESLTINCVLRDNNCALSTTYWYRKKSGSTNEENISKGGRYVETVNSGSKSFSLKINDLTVEDSGTYRCNVRLAGMWICLNWYDADGGGTAVTVNA

SEQ ID NO: 212 - protein, 110 aa, Artificial Sequence
  source: /note="Description of Artificial Sequence: Synthetic polypeptide"
ARVDQTPQTITKETGESLTINCVLRDSICALASTYWYRKKSGSTNEESISKGGRYVETNKSGSKSFSLKINDLTVEDSGTYRCNVYSWIRDYDCAGGDVYGGGTAVTVNA

SEQ ID NO: 213 - protein, 110 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVKDSGTYRCNLWGWYDCALGANYDVYGGGTVVTVNA

SEQ ID NO: 214 - protein, 110 aa, Artificial Sequence
  source: /note="Description of Artificial Sequence: Synthetic polypeptide"
ARVDQTPQTITKETGESLTINCVLRDSNCALSSTYWSRKKSGSTNEESISKGGRYVETVNSGSKSFSLRINDLTVEDSGTYRCNSLVYDCRTGPVRGDVYGGGTVVTVNA

SEQ ID NO: 215 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNGVIAGGDCHPYNYDVYGGGTAVTVNA

SEQ ID NO: 216 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWLVRIFLCPNFRDVYGDGTVVTVNA

SEQ ID NO: 217 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVPSWYFMVHCTEDDVYGDGTAVTVNA

SEQ ID NO: 218 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVASWYWGCRQGTGDVYGGGTVVTVNA

SEQ ID NO: 219 - protein, 110 aa, Artificial Sequence
  source: /note="Description of Artificial Sequence: Synthetic polypeptide"
ARVDQTPQSITKETGESLTINCVLRDSNCALSSTYWYRKKSGSTNEESISKGGRYVETVNSGSKSFSLRINDLTVEDSGTYRCNVGIGYDCPAELAWGVYGGGTVVTVNA

SEQ ID NO: 220 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYIETVNSGSKSFSLRINDLTVEDSGTYRCNVYRYQLSSLDCNHDVYGGGTAVTVNA

SEQ ID NO: 221 - protein, 110 aa, Artificial Sequence; identical to SEQ ID NO: 220
  source: /note="Description of Artificial Sequence: Synthetic polypeptide"

SEQ ID NO: 222 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVPPAGRYEHCDWTGVYGGGTVVTVNA

SEQ ID NO: 223 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVFPRWGYDCGTDLDVYGGGTVVTVNA

SEQ ID NO: 224 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWIAGGICLRGPYDVYGGGTAVTVNA

SEQ ID NO: 225 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNTESISKGGRYVETVNSGSKSFSLRINDLTVGDSGAYRCQIWWNIAGICGGLSNVYGGGTVVTVNA

SEQ ID NO: 226 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEETISKGGRYVETVNSGSKRFSLRINDLTVGDNGTYRCRVWGSYGGGLRCSNDVYGGGTVVTVNA

SEQ ID NO: 227 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNAESWYQGTSRLGCDVYGDGTAVTVNA

SEQ ID NO: 228 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWAGYSYDCGGWREVYGGGTAVTVNA

SEQ ID NO: 229 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKAAGYEFGCLNWGNDVYGGGTVVTVNA

SEQ ID NO: 230 - protein, 110 aa, Artificial Sequence
  source: /note="Description of Artificial Sequence: Synthetic polypeptide"
ARVDQTPQTLTKETGESLTINCVLRDSNCPLSRTYWYRSKSGSTNEESIKKGGRYVETVNRGSKSSSLRINDLIVEDAGTYRCKLHSLTGYGCLRDWDAYGGGTAVTVNA

SEQ ID NO: 231 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKGVAICPMTADWFQDVYGGGTVVTVNA

SEQ ID NO: 232 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVYPAGMSYDCGLYDVYGGGTVVTVNA

SEQ ID NO: 233 - protein, 110 aa, Artificial Sequence
  source: /note="Description of Artificial Sequence: Synthetic polypeptide"
ARVDQTPQTITRVTGESLTINCVLRDNNCAMSNTYWFRKKSGSTNEENISKGGRYVETVNTGSKSFSLRINDLTVEDSGTYRCNVRLRGLWICLNWHDADGDGTAVTVNA

SEQ ID NO: 234 - protein, 111 aa, Artificial Sequence
  source: /note="Description of Artificial Sequence: Synthetic polypeptide"
ARVDQTPQTITKETGESLTINCVLRDSGCALSSTYFYRKKSGSTNEESISKGGRYVETVNSGSKSFSLRINDLTVEDSGTYRCKVGVRAGPICLGRGYDVYGDGTAVTVNA

SEQ ID NO: 235 - protein, 111 aa, Artificial Sequence
  source: /note="Description of Artificial Sequence: Synthetic polypeptide"
ARVDQTPQTITKETGESLTINCVLRDSKCALSSTSWLRKKSGSTNEESISKGGRYVETVNSESKSFSLRINDLTVEDSGTYRCGAQCKAGASDWGLSYDVYGGGTVVTVNA

SEQ ID NO: 236 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDNGTYRCKTQLVWTVACGDWRRDVYGGGTVVTVNA

SEQ ID NO: 237 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYPAGILYDCRWMDDVYGGGTVVTVNA

SEQ ID NO: 238 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYWHGSLRDCASGLNVYGDGTAVTVNA

SEQ ID NO: 239 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVFAGMDYDCGLYNYDVYGGGTAVTVNA

SEQ ID NO: 240 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVAGRGSYDCRTGVYDVYGGGTAVTVNA

SEQ ID NO: 241 - protein, 111 aa, Artificial Sequence
  source: /note="Description of Artificial Sequence: Synthetic polypeptide"
ARVDQTPQTITKETGESLTINCVLRDSNCALSWTYWYRKKSGSTNEESISKGGRYVETVNSGSKSFSLRINDLTVEDSGTYRCNALVWEICITELEIRDVYGGGTAVTVNA

SEQ ID NO: 242 - protein, 111 aa, Artificial Sequence
  source: /note="Description of Artificial Sequence: Synthetic polypeptide"
ARVDQTPQSITKETGESLTINCVLRDSNCALSSTYWYRKKSGSTNEESISKGGRYVETVNSGSKSFSLRINDLTVEDSGTYRCKAHWDCALNWIPTLYDVYGGGTVVTVNA

SEQ ID NO: 243 - protein, 111 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCKGRGRITHDCTGVKYDVYGGGTVVTVNA

SEQ ID NO: 244 - protein, 111 aa, Artificial Sequence
  source: /note="Description of Artificial Sequence: Synthetic polypeptide"
ARVDQTPQTITKETGESLTINCVVRDSNCAVTSTYWYRKKSGSTNEEHISKGGRYVETVNSGSKSFSLRINDVTVEDSGTYRCNVYAESIRPYDCAYFDPYGGGTAVTVNA

SEQ ID NO: 245 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVYLRAGIYDCKLNWNRYGGGTAVTVNA

SEQ ID NO: 246 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKTDPVWGDCRLARRYDVYGGGTAVTVNA

SEQ ID NO: 247 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNSILVWRWDCPELGYDVYGGGTAVTVNA

SEQ ID NO: 248 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVSPELVSPRYDCGYEDVYGGGTVVTVNA

SEQ ID NO: 249 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYGPYISDCETGLRRDVYGGGTVVTVNA

SEQ ID NO: 250 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVLLVWIYGGYDCAPVDVYGGGTVVTVNA

SEQ ID NO: 251 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYPSIAGIGYDCYNYDVYGGGTVVTVNA

SEQ ID NO: 252 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKAGMDYDCDNPRNWLYDVYGDGTAVTVNA

SEQ ID NO: 253 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVFDAGMGSYDWGTACDVYGGGTVVTVNA

SEQ ID NO: 254 - protein, 112 aa, Artificial Sequence
  source: /note="Description of Artificial Sequence: Synthetic polypeptide"
ARVDQTPQTITKETGESLTINCVLRDSNCALSSTYWYRKKSASTNEESISKGGRYVEIVNSGSKSFSLRINDLTVEDSGTYRCNVPVKCGTTQTWRLAYDVYGGGTAVTVNA

SEQ ID NO: 255 - protein, 112 aa, Artificial Sequence; identical to SEQ ID NO: 254
  source: /note="Description of Artificial Sequence: Synthetic polypeptide"

SEQ ID NO: 256 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKSWYDCPRYTAELVISGVYGGGTVVTVNA

SEQ ID NO: 257 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVLGSYDCPEENYPIYDVYGGGTAVTVNA

SEQ ID NO: 258 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVMSSQYDYEYCTHNYDVYGDGTAVTVNA

SEQ ID NO: 259 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTLEDSGTYRCKSICPSLSLYGTDHWYDVYGGGTAVTVNA

SEQ ID NO: 260 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVTVWIGYDCGGNWKDDVYGGGTVVTVNA

SEQ ID NO: 261 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVLGRADCRVNWTHNYDVYGGGTVVTVNA

SEQ ID NO: 262 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVVLGLVCRKNWRDPYDVYGGGTVVTVNA

SEQ ID NO: 263 - protein, 112 aa, Artificial Sequence
  source: /note="Description of Artificial Sequence: Synthetic polypeptide"
ARVDQTPQTITKEKGESLTINCVLRDSECALSKTYWYHKKTGSTNEDLVSKGGRYVETVNRGSKSFSLRINDLRVEDSGTYRCKVYRYYGFYVCLLGDYDVYGGGTVVTVNA

SEQ ID NO: 264 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKASGVCWYSQTGPGNYDVYGDGTAVTVNA

SEQ ID NO: 265 - protein, 112 aa, Artificial Sequence
  source: /note="Description of Artificial Sequence: Synthetic polypeptide"
ARVDQTPQTITKETGESLTINCVLRDSNCALSSTSWYRKKSGSTNEESISKGGRYVETVRSLEQSFSLRINDLTVRDSGTYRCKSELLCLAMTGVFMDSHVYGGGTAVTVNA

SEQ ID NO: 266 - protein, 112 aa, Artificial Sequence
  source: /note="Description of Artificial Sequence: Synthetic polypeptide"
ARVDQTPQTITKETGESLTIKCVLRDSNCALSSTYWSRKSSGSTNEESISKGGRYVETANTDAKSFSLRINDLTVEDSGTYRCKYWGIEEDNGRWRNCQGGAGGGTVVTVNA

SEQ ID NO: 267 - protein, 112 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKTLFSGMLVCRSNWMEDVYGGGTVVTVNA

SEQ ID NO: 268 - protein, 113 aa, Artificial Sequence
  source: /note="Description of Artificial Sequence: Synthetic polypeptide"
ARVDQTPQTITKETGESLTINCVLRDSNCAFSSTYWYRKKSGSRNEVRISKGGRYVETVNSGSKSFSLRINDLTVEDSGTYRCNVLDISYDCVWKLDGSYDVYGGGTAVTVNA

SEQ ID NO: 269 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVLELVSIRDDDWYCNYDLFGGGTAVTVNA

SEQ ID NO: 270 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYTTGTVYDCPLRGRSDVYGGGTAVTVNA

SEQ ID NO: 271 - protein, 113 aa, Artificial Sequence
  source: /note="Description of Artificial Sequence: Synthetic polypeptide"
ARVDQTPQTITKETGESLTINCVLRDSNCALSSTYWYRKLSGSTNEESISKGGRYVETVNSGSKSFSLRINDLTVEDSGTYRCNVWSRCWYVTGLPELESGVYGGGTVVTVNA

SEQ ID NO: 272 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNQESISPGGRYVETVNSGSKSFSLRINDLTVEDSGTYRCKVSSSLVSSYDCGLDWSSQYGGGTVVTVNA

SEQ ID NO: 273 - protein, 113 aa, Artificial Sequence
  source: /note="Description of Artificial Sequence: Synthetic polypeptide"
ARVDQTPQTITKETGESLTINCVLRDSNCDLSSTYWYRKKSGSTNEKNISKGGRYVETVNSGSKSFSLRINDLTVEDSGTYRCNVLIAAMGCHNYDSLLEDVYGGGTVVTVNA

SEQ ID NO: 274 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDGGTYHCGVTSWFSCDYIHSYPLSAARGDGTVVTVNA

SEQ ID NO: 275 - protein, 113 aa, Artificial Sequence
  source: /note="Description of Artificial Sequence: Synthetic polypeptide"
ARVDQTPQTITKETGESLTINCVLRDRNCALSSTYWYRKKSGSTNEESISKGGRYVETVNSGSKSFSLRINDLTVEDSGTYRCNVYKGAHIAEDCELNWSDVYGGGTAVTVNA

SEQ ID NO: 276 - protein, 113 aa, Artificial Sequence
  source: /note="Description of Artificial Sequence: Synthetic polypeptide"
ARVDQTPQTMSKETGESLTINCLLRDSNCVLSSTYWYRKKSGSTNEETVSKGGRYVETVNSGSKSFHLRINDLTVEDSGTYRCKVSLGHSYDCPGNWFGRDVYGGGTVVTVNA

SEQ ID NO: 277 - protein, 113 aa, Artificial Sequence
  source: /note="Description of Artificial Sequence: Synthetic polypeptide"
ARVDQTPQTITKETGESLTINCVLRDSSCPLSSGYWYRKKSDSTNEENISKGGRYVETVNSGSKSHSLRINDLTVEDSGTYRCKLTTNSWTCIGHELATKGVYGGGTAVTVNA

SEQ ID NO: 278 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKPSWYPGVCAGSNWRSHDVYGGGTVVTVNA

SEQ ID NO: 279 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVFHGWYGCYDSRTGGPDVYGGGTVVTVNA

SEQ ID NO: 280 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVFDFWYPTNSYDCLELMGHGGGTAVTVNA

SEQ ID NO: 281 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVYLVGYDCAPSWAPVPDVYGGGTAVTVNA

SEQ ID NO: 282 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVDPIGGYSYALNWRCRDVYGDGTAVTVNA

SEQ ID NO: 283 - protein, 113 aa, Artificial Sequence
  source: /note="Description of Artificial Sequence: Synthetic polypeptide"
ARVDQTPQTITKETGESLTINCVLRDSNCALSSTYWYREKSGSTNEESISKGGRYVETVNSGSKSFSLRINDLTVEDSGTYRCNVWIAGTHYDSERCRYYDVYGDGTAVTVNA

SEQ ID NO: 284 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYPIAGICGTGERNNYDVYGGGTVVTVNA

SEQ ID NO: 285 - protein, 114 aa, Artificial Sequence
  source: /note="Description of Artificial Sequence: Synthetic polypeptide"
ARVDQTPRSVTKETGESLTINCVLRDSICALSSTHWYRKKSGSTNEESISKGGRYVETVNSGSKSFSLRINDLTVEDSGTYRCKVRPLLPYGGYDCAVLGEEIYGDGTVVTVNA

SEQ ID NO: 286 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYLGAGIRYDCGDPLNYDVYGDGTVVTVNA

SEQ ID NO: 287 - protein, 114 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLRINDLTVEDSGTYRCNVWKKAGMIGYDCGLQARDVYGGGTVVTVNA

SEQ ID NO: 288 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYRWAGMDPDDCDSDSTDVYGGGTVVTVNA

SEQ ID NO: 289 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVYSSPSIYDCVRTGYNYDVYGGGTVVTVNA

SEQ ID NO: 290 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKSGRYVETVNSGSKSFSLRINDLTVEDSGTYRCKVPAFQEIVGRCFLDPSDDVYGGGTVVTVNA

SEQ ID NO: 291 - protein, 114 aa, Artificial Sequence
  source: /note="Description of Artificial Sequence: Synthetic polypeptide"
ARVDQTPRSVTKETGESLTINCVLRDSNCPLDATYWYRTKKGSTPEESISKGGRYVETVNSGSKSFSLRINDLTVEDSGTLRCKVFPRFGTGPGDCAFHQEDVSGGGTVVTVNA

SEQ ID NO: 292 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVWSWDIPSDMPNWSCNYDVYGGGTVVTVNA

SEQ ID NO: 293 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVWYCRRIYPGELNWDNYDVYGGGTAVTVNA

SEQ ID NO: 294 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCQTIFGMWDQVCIYGNSRYDVYGGGTVVTVNA

SEQ ID NO: 295 - protein, 114 aa, Artificial Sequence
  source: /note="Description of Artificial Sequence: Synthetic polypeptide"
ARVDQTPQTITKETGESLTINCVLRDSNCPLDATYWYRTKRDSTNEETISITGRYVETVNNEAKSFSLRIYDLRSEDSGTLRCKVFPRFGTGPGSCAFYQEDVYGDGTAVTVNA

SEQ ID NO: 296 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVWECRVYDYGNELEIGLAVYGDGTAVTVNA

SEQ ID NO: 297 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWPRWYGTDCSHELYNYDVYGGGTVVTVNA

SEQ ID NO: 298 - protein, 115 aa, Artificial Sequence
  source: /note="Description of Artificial Sequence: Synthetic polypeptide"
ARVDQTPQTITKETGESLTINCVLRDSNCALASTYWSRKKSGSSNEESISKGGRYVETVNSGSKSSSLRINDLTVEDSGTWRCNVFSSITKMYPFPSRVNCDDVYGDGTAVTVNA

SEQ ID NO: 299 - protein, 115 aa, Artificial Sequence
  source: /note="Description of Artificial Sequence: Synthetic polypeptide"
ARVDQTPQTITKETGESLTINCVLRDSNCALSSTYWYRKKSGSTNEESISTGGRYVETVNSGSKSFSLRINDLTVEDSGTYRCNVYRRGELVGPYSRCELGSGVYGGGTAVTVNA

SEQ ID NO: 300 - protein, 115 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVPAGIDPVYDCAGGNWPGDVYGGGTAVTVNA

SEQ ID NO: 301 - protein, 115 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKAYGVWDSCIGWRWGGQGYDVYGDGTAVTVNA

SEQ ID NO: 302 - protein, 115 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVSTKLVYYDCASPAYVGYDVYGGGTAVTVNA

SEQ ID NO: 303 - protein, 115 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVSGWYTRGYDCRYNWSGDDVYGDGTAVTVNA

SEQ ID NO: 304 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVLVRAGASYDCAAPYEYDVYGGGTVVTVNA

SEQ ID NO: 305 - protein, 116 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVWDHHSWYGSDSYDCRGTGDVYGGGTAVTVNA

SEQ ID NO: 306 - protein, 116 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVYGRYSWYGSRDCELGSGDDVYGGGTVVTVNA

SEQ ID NO: 307 - protein, 116 aa, Artificial Sequence
  source: /note="Description of Artificial Sequence: Synthetic polypeptide"
ARVDQTPQTITKETGESLTINCVLRDSNCTLSSTYWYRSASGSTSEESISKGGRYVETVNSGSKSFSLRINDLTVEDSGTYRCKVLRCMTDLYGLGAGGRGPLDVYGGGTAVTVNA

SEQ ID NO: 308 - protein, 116 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVYSLVCRDDQLNWRGPYNYDVYGGGTVVTVNA

SEQ ID NO: 309 - protein, 116 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLIVEDSGTYRCKVLCHSRWYPSMTASDWIMADVYGGGTVVTVNA

SEQ ID NO: 310 - protein, 117 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVSSGAIAGAYDCAETGWYNYDVYGGGTVVTVNA

SEQ ID NO: 311 - protein, 118 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKFFSLRINDLTVEDSGSYRCKVPHRADSWCTGGDYDSNLGYYDVYGDGTVVTVNA

SEQ ID NO: 312 - protein, 119 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVMGSWYTYDCDRGELNWWTNNYDVYGGGTAVTVNA

SEQ ID NO: 313 - protein, 120 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCKVSLGPIYSWYGLPPQRYDCASGLDVYGGGTVVTVNA

SEQ ID NO: 314 - protein, 121 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVEDSGTYRCKVWELAGPMFLCVLDGEVAELDPLYDVYGGGTVVTVNA

SEQ ID NO: 315 - protein, 11 aa, Artificial Sequence
  source: /note="Description of Artificial Sequence: Synthetic peptide"
YGGGTVVTVNA

SEQ ID NO: 316 - protein, 11 aa, Artificial Sequence
  source: /note="Description of Artificial Sequence: Synthetic peptide"
YGGGTAVTVNA

SEQ ID NO: 317 - protein, 11 aa, Artificial Sequence
  source: /note="Description of Artificial Sequence: Synthetic peptide"
YGDGTAVTVNA

SEQ ID NO: 318 - protein, 11 aa, Artificial Sequence
  source: /note="Description of Artificial Sequence: Synthetic peptide"
YGDGTVVTVNA

SEQ ID NO: 319 - protein, 83 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRC

SEQ ID NO: 320 - protein, 83 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLRINDLTVEDSGTYRC

SEQ ID NO: 321 - protein, 83 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVKDSGTYRC

SEQ ID NO: 322 - protein, 83 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLRINDLTVEDSGTYRC

SEQ ID NO: 323 - protein, 83 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLVVEDSGTYRC

SEQ ID NO: 324 - protein, 83 aa, Artificial Sequence
  source: /note="Description of Artificial Sequence: Synthetic polypeptide"
ARVDQTPRSVTKETGESLTINCVLRDSICALSSTHWYRKKSGSTNEESISKGGRYVETVNSGSKSFSLRINDLTVEDSGTYRC

SEQ ID NO: 325 - protein, 83 aa, Artificial Sequence
  source: /note="Description of Artificial Sequence: Synthetic polypeptide"
ARVDQTPQTITKETGESLTINCVLRDNNCALSTTYWYRKKSGSTNEENISKGGRYVETVNSGSKSFSLKINDLTVEDSGTYRC

SEQ ID NO: 326 - protein, 83 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRC

SEQ ID NO: 327 - protein, 83 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRC

SEQ ID NO: 328 - protein, 83 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRC

SEQ ID NO: 329 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgcattgtccagcacgtactggtatcgcaaaaaatcgggctcaacaaacgaggagagcatatcgaaaggtggacgatatgttgaaacagttaacagcggatcaaagtccttttctttgagaattaatgatctaacagttgaagacagtggcacgtatcgatgc

SEQ ID NO: 330 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgcattgtccagcacgtactggtatcgcaaaaaatcggactcaacaaacgaggagagcatatcgaaaggtggacgatatgttgaaacagttaacagcggatcaaagtccttttctttgagaattaatgatctaacagttgaagacagtggcacgtatcgatgc

SEQ ID NO: 331 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgcattacccagtacgtactggtatcgcaaaaaatcgggctcaacaaacgaggagagcatatcgaaaggtggacgatatgttgaaacagttaacagcggatcaaagtccttttctttgagaattaatgatctaacagtgaaagacagtggcacgtatcgatgc

SEQ ID NO: 332 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgcattgtccagcacgtactggtatcgcaaaaaatcgggctcaacaaacgaggagaacatatcgaaaggtggacgatatgttgaaacagttaacagcggatcaaagtccttttctttgagaattaatgatctaacagttgaagacagtggcacgtatcgatgc

SEQ ID NO: 333 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgatttgtccaggacgtactggtatcgcaaaaaatcgggctcaacaaacgaggagagtatatcgaaaggtggacgatatgttgaaacagttaacagcggatcaaagtccttttctttgagaattaatgatcttgtagttgaagacagtggcacgtatcgatgc

SEQ ID NO: 334 - DNA, 249 bp, Artificial Sequence
  source: /note="Description of Artificial Sequence: Synthetic polynucleotide"
gctcgagtggaccaaacaccgagatcagtaacaaaggagacgggcgaatcactgaccatcaactgtgtcctacgagatagtatttgtgcattgtccagcacgcactggtatcgcaaaaaatcgggctcaacaaacgaggagagcatatcgaaaggtggacgatatgttgaaacagttaacagcggatcaaagtccttttctttgagaattaatgatctaacagttgaagacagtggcacgtatcgatgc

SEQ ID NO: 335 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagataacaattgtgcattgtccacgacgtactggtatcgcaaaaaatcgggctcaacaaacgaggagaacatatcgaaaggtggacgatatgttgaaacagttaacagcggatcaaagtccttttctttgaaaattaatgatctaacagttgaagacagtggcacgtatcgatgc

SEQ ID NO: 336 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgcattgtccaacctgtactggtatcgcaaaaaatcgggctcaacaaacgaggagagcatatcgctaggtggacgatatgttgaaacagttaacagcggatcaaagtccttttctttgagaattaatgatctaacagttgaagacagtggcacgtatcgatgc

SEQ ID NO: 337 - DNA, 249 bp, Artificial Sequence
  source: /note="Description of Artificial Sequence: Synthetic polynucleotide"
gctcgagtggaccaaacaccgcaaacaataacaaaggagacgggcgaatcactgaccatcaactgtgtcctacgagatagtaactgtgaattgtccagcacgtactggtatcgcaaaaaatcgggctcaacaaacgaggcgcgcatatcgaaaggtggacgatatgttgaaacagttaacagcggatcaaagtccttttctttgagaattaatgatctaacagttgaagacagtggcacgtatcgatgc

SEQ ID NO: 338 - DNA, 249 bp, Artificial Sequence
  source: /note="Description of Artificial Sequence: Synthetic polynucleotide"
gctcgagtggaccaaacaccgcaaactgtaacaaaggagacgggcgaatcactgaccatcaactgtgtcctacgagatagtaactgtgcattgtccagcacactctggtatcgcactaaatcgggctcaaggaacgaggagagcatatcgaaaggtggacgatatgttgaaacagttaacagcggatcaaagtccttttctttgaaaattaatgatctaacagttgaagacagtggcacgtatcgatgc

SEQ ID NO: 339 - protein, 20 aa, Artificial Sequence
  source: /note="Description of Artificial Sequence: Synthetic peptide"
  MOD_RES (4)..(7): Any amino acid
  MOD_RES (9)..(12): Any amino acid
CNVXXXXCXXXXDVYGGGTV

SEQ ID NO: 340 - protein, 20 aa, Artificial Sequence
  source: /note="Description of Artificial Sequence: Synthetic peptide"
  MOD_RES (4)..(7): Any amino acid
  MOD_RES (9)..(12): Any amino acid
CNVXXXXCXXXXDVYGGGTA

SEQ ID NO: 341 - protein, 20 aa, Artificial Sequence
  source: /note="Description of Artificial Sequence: Synthetic peptide"
  MOD_RES (4)..(7): Any amino acid
  MOD_RES (9)..(12): Any amino acid
CNVXXXXCXXXXDVYGDGTA

SEQ ID NO: 342 - protein, 20 aa, Artificial Sequence
  source: /note="Description of Artificial Sequence: Synthetic peptide"
  MOD_RES (4)..(6): Any amino acid
  VARIANT (7)..(9): /replace="Ser" or "Asp" or "Gly" or "Tyr" or "Cys"
  MOD_RES (10)..(12): Any amino acid
  misc_feature (1)..(20): /note="Variant residues given in the sequence have no preference with respect to those in the annotations for variant positions"
CNVXXXNNNXXXDVYGGGTV

SEQ ID NO: 343 - protein, 20 aa, Artificial Sequence
  source: /note="Description of Artificial Sequence: Synthetic peptide"
  MOD_RES (4)..(6): Any amino acid
  VARIANT (7)..(9): /replace="Ser" or "Asp" or "Gly" or "Tyr" or "Cys"
  MOD_RES (10)..(12): Any amino acid
  misc_feature (1)..(20): /note="Variant residues given in the sequence have no preference with respect to those in the annotations for variant positions"
CNVXXXNNNXXXDVYGGGTA

SEQ ID NO: 344 - protein, 20 aa, Artificial Sequence
  source: /note="Description of Artificial Sequence: Synthetic peptide"
  MOD_RES (4)..(6): Any amino acid
  VARIANT (7)..(9): /replace="Ser" or "Asp" or "Gly" or "Tyr" or "Cys"
  MOD_RES (10)..(12): Any amino acid
  misc_feature (1)..(20): /note="Variant residues given in the sequence have no preference with respect to those in the annotations for variant positions"
CNVXXXNNNXXXDVYGDGTA

SEQ ID NO: 345 - protein, 21 aa, Artificial Sequence
  source: /note="Description of Artificial Sequence: Synthetic peptide"
  MOD_RES (4)..(8): Any amino acid
  MOD_RES (10)..(13): Any amino acid
CNVXXXXXCXXXXDVYGGGTV

SEQ ID NO: 346 - protein, 21 aa, Artificial Sequence
  source: /note="Description of Artificial Sequence: Synthetic peptide"
  MOD_RES (4)..(8): Any amino acid
  MOD_RES (10)..(13): Any amino acid
CNVXXXXXCXXXXDVYGGGTA

SEQ ID NO: 347 - protein, 21 aa, Artificial Sequence
  source: /note="Description of Artificial Sequence: Synthetic peptide"
  MOD_RES (4)..(8): Any amino acid
  MOD_RES (10)..(13): Any amino acid
CNVXXXXXCXXXXDVYGDGTA

SEQ ID NO: 348 - protein, 21 aa, Artificial Sequence
  source: /note="Description of Artificial Sequence: Synthetic peptide"
  MOD_RES (4)..(6): Any amino acid
  VARIANT (7)..(9): /replace="Ser" or "Asp" or "Gly" or "Tyr" or "Cys"
  MOD_RES (10)..(13): Any amino acid
  misc_feature (1)..(21): /note="Variant residues given in the sequence have no preference with respect to those in the annotations for variant positions"
CNVXXXNNNXXXXDVYGGGTV

SEQ ID NO: 349 - protein, 21 aa, Artificial Sequence
  source: /note="Description of Artificial Sequence: Synthetic peptide"
  MOD_RES (4)..(6): Any amino acid
  VARIANT (7)..(9): /replace="Ser" or "Asp" or "Gly" or "Tyr" or "Cys"
  MOD_RES (10)..(13): Any amino acid
  misc_feature (1)..(21): /note="Variant residues given in the sequence have no preference with respect to those in the annotations for variant positions"
CNVXXXNNNXXXXDVYGGGTA

SEQ ID NO: 350 - protein, 21 aa, Artificial Sequence
  source: /note="Description of Artificial Sequence: Synthetic peptide"
  MOD_RES (4)..(6): Any amino acid
  VARIANT (7)..(9): /replace="Ser" or "Asp" or "Gly" or "Tyr" or "Cys"
  MOD_RES (10)..(13): Any amino acid
  misc_feature (1)..(21): /note="Variant residues given in the sequence have no preference with respect to those in the annotations for variant positions"
CNVXXXNNNXXXXDVYGDGTA

SEQ ID NO: 351 - protein, 22 aa, Artificial Sequence
  source: /note="Description of Artificial Sequence: Synthetic peptide"
  MOD_RES (4)..(10): Any amino acid
  MOD_RES (12)..(14): Any amino acid
CNVXXXXXXXCXXXDVYGGGTV

SEQ ID NO: 352 - protein, 22 aa, Artificial Sequence
  source: /note="Description of Artificial Sequence: Synthetic peptide"
  MOD_RES (4)..(10): Any amino acid
  MOD_RES (12)..(14): Any amino acid
CNVXXXXXXXCXXXDVYGGGTA

SEQ ID NO: 353 - protein, 22 aa, Artificial Sequence
  source: /note="Description of Artificial Sequence: Synthetic peptide"
  MOD_RES (4)..(10): Any amino acid
  MOD_RES (12)..(14): Any amino acid
CNVXXXXXXXCXXXDVYGDGTA

SEQ ID NO: 354 - protein, 22 aa, Artificial Sequence
  source: /note="Description of Artificial Sequence: Synthetic peptide"
  MOD_RES (4)..(8): Any amino acid
  VARIANT (9)..(11): /replace="Ser" or "Asp" or "Gly" or "Tyr" or "Cys"
  MOD_RES (12)..(14): Any amino acid
  misc_feature (1)..(22): /note="Variant residues given in the sequence have no preference with respect to those in the annotations for variant positions"
CNVXXXXXNNNXXXDVYGGGTV

SEQ ID NO: 355 - protein, 22 aa, Artificial Sequence
  source: /note="Description of Artificial Sequence: Synthetic peptide"
  MOD_RES (4)..(8): Any amino acid
  VARIANT (9)..(11): /replace="Ser" or "Asp" or "Gly" or "Tyr" or "Cys"
  MOD_RES (12)..(14): Any amino acid
  misc_feature (1)..(22): /note="Variant residues given in the sequence have no preference with respect to those in the annotations for variant positions"
CNVXXXXXNNNXXXDVYGGGTA

SEQ ID NO: 356 - protein, 22 aa, Artificial Sequence
  source: /note="Description of Artificial Sequence: Synthetic peptide"
  MOD_RES (4)..(8): Any amino acid
  VARIANT (9)..(11): /replace="Ser" or "Asp" or "Gly" or "Tyr" or "Cys"
  MOD_RES (12)..(14): Any amino acid
  misc_feature (1)..(22): /note="Variant residues given in the sequence have no preference with respect to those in the annotations for variant positions"
CNVXXXXXNNNXXXDVYGDGTA

SEQ ID NO: 357 - protein, 23 aa, Artificial Sequence
  source: /note="Description of Artificial Sequence: Synthetic peptide"
  MOD_RES (4)..(10): Any amino acid
  MOD_RES (12)..(15): Any amino acid
CNVXXXXXXXCXXXXDVYGGGTV

SEQ ID NO: 358 - protein, 23 aa, Artificial Sequence
  source: /note="Description of Artificial Sequence: Synthetic peptide"
  MOD_RES (4)..(10): Any amino acid
  MOD_RES (12)..(15): Any amino acid
CNVXXXXXXXCXXXXDVYGGGTA

SEQ ID NO: 359 - protein, 23 aa, Artificial Sequence
  source: /note="Description of Artificial Sequence: Synthetic peptide"
  MOD_RES (4)..(10): Any amino acid
  MOD_RES (12)..(15): Any amino acid
CNVXXXXXXXCXXXXDVYGDGTA

SEQ ID NO: 360 - protein, 23 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(15): Any amino acid
  misc_feature (1)..(23): /note="Variant residues given in the sequence have no preference with respect to those in the annotations for variant positions"
CNVXXXXXXNNNXXXDVYGGGTV

SEQ ID NO: 361 - protein, 23 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(15): Any amino acid
  misc_feature (1)..(23): /note="Variant residues given in the sequence have no preference with respect to those in the annotations for variant positions"
CNVXXXXXXNNNXXXDVYGGGTA

SEQ ID NO: 362 - protein, 23 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(15): Any amino acid
  misc_feature (1)..(23): /note="Variant residues given in the sequence have no preference with respect to those in the annotations for variant positions"
CNVXXXXXXNNNXXXDVYGDGTA

SEQ ID NO: 363 - protein, 24 aa, Artificial Sequence
  source: /note="Description of Artificial Sequence: Synthetic peptide"
  MOD_RES (4)..(10): Any amino acid
  MOD_RES (12)..(16): Any amino acid
CNVXXXXXXXCXXXXXDVYGGGTV

SEQ ID NO: 364 - protein, 24 aa, Artificial Sequence
  source: /note="Description of Artificial Sequence: Synthetic peptide"
  MOD_RES (4)..(10): Any amino acid
  MOD_RES (12)..(16): Any amino acid
CNVXXXXXXXCXXXXXDVYGGGTA

SEQ ID NO: 365 - protein, 24 aa, Artificial Sequence
  source: /note="Description of Artificial Sequence: Synthetic peptide"
  MOD_RES (4)..(10): Any amino acid
  MOD_RES (12)..(16): Any amino acid
CNVXXXXXXXCXXXXXDVYGDGTA

SEQ ID NO: 366 - protein, 24 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(16): Any amino acid
  misc_feature (1)..(24): /note="Variant residues given in the sequence have no preference with respect to those in the annotations for variant positions"
CNVXXXXXXNNNXXXXDVYGGGTV

SEQ ID NO: 367 - protein, 24 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(16): Any amino acid
  misc_feature (1)..(24): /note="Variant residues given in the sequence have no preference with respect to those in the annotations for variant positions"
CNVXXXXXXNNNXXXXDVYGGGTA

SEQ ID NO: 368 - protein, 24 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(16): Any amino acid
  misc_feature (1)..(24): /note="Variant residues given in the sequence have no preference with respect to those in the annotations for variant positions"
CNVXXXXXXNNNXXXXDVYGDGTA

SEQ ID NO: 369 - protein, 25 aa, Artificial Sequence
  source: /note="Description of Artificial Sequence: Synthetic peptide"
  MOD_RES (4)..(10): Any amino acid
  MOD_RES (12)..(17): Any amino acid
CKVXXXXXXXCXXXXXXDVYGGGTV

SEQ ID NO: 370 - protein, 25 aa, Artificial Sequence
  source: /note="Description of Artificial Sequence: Synthetic peptide"
  MOD_RES (4)..(10): Any amino acid
  MOD_RES (12)..(17): Any amino acid
CKVXXXXXXXCXXXXXXDVYGGGTA

SEQ ID NO: 371 - protein, 25 aa, Artificial Sequence
  source: /note="Description of Artificial Sequence: Synthetic peptide"
  MOD_RES (4)..(10): Any amino acid
  MOD_RES (12)..(17): Any amino acid
CKVXXXXXXXCXXXXXXDVYGDGTA

SEQ ID NO: 372 - protein, 25 aa, Artificial Sequence
  source: /note="Description of Artificial Sequence: Synthetic peptide"
  MOD_RES (4)..(6): Any amino acid
  VARIANT (7)..(7): /replace="Ser" or "Asp" or "Gly" or "Tyr" or "Cys"
  MOD_RES (8)..(8): Any amino acid
  VARIANT (9)..(9): /replace="Ser" or "Asp" or "Gly" or "Tyr" or "Cys"
  MOD_RES (10)..(10): Any amino acid
  VARIANT (11)..(11): /replace="Ser" or "Asp" or "Gly" or "Tyr" or "Cys"
  MOD_RES (12)..(17): Any amino acid
  misc_feature (1)..(25): /note="Variant residues given in the sequence have no preference with respect to those in the annotations for variant positions"
CKVXXXNXNXNXXXXXXDVYGGGTV

SEQ ID NO: 373 - protein, 25 aa, Artificial Sequence
  source: /note="Description of Artificial Sequence: Synthetic peptide"
  MOD_RES (4)..(6): Any amino acid
  VARIANT (7)..(7): /replace="Ser" or "Asp" or "Gly" or "Tyr" or "Cys"
  MOD_RES (8)..(8): Any amino acid
  VARIANT (9)..(9): /replace="Ser" or "Asp" or "Gly" or "Tyr" or "Cys"
  MOD_RES (10)..(10): Any amino acid
  VARIANT (11)..(11): /replace="Ser" or "Asp" or "Gly" or "Tyr" or "Cys"
  MOD_RES (12)..(17): Any amino acid
  misc_feature (1)..(25): /note="Variant residues given in the sequence have no preference with respect to those in the annotations for variant positions"
CKVXXXNXNXNXXXXXXDVYGGGTA

SEQ ID NO: 374 - protein, 25 aa, Artificial Sequence
  source: /note="Description of Artificial Sequence: Synthetic peptide"
  MOD_RES (4)..(6): Any amino acid
  VARIANT (7)..(7): /replace="Ser" or "Asp" or "Gly" or "Tyr" or "Cys"
  MOD_RES (8)..(8): Any amino acid
  VARIANT (9)..(9): /replace="Ser" or "Asp" or "Gly" or "Tyr" or "Cys"
  MOD_RES (10)..(10): Any amino acid
  VARIANT (11)..(11): /replace="Ser" or "Asp" or "Gly" or "Tyr" or "Cys"
  MOD_RES (12)..(17): Any amino acid
  misc_feature (1)..(25): /note="Variant residues given in the sequence have no preference with respect to those in the annotations for variant positions"
CKVXXXNXNXNXXXXXXDVYGDGTA

SEQ ID NO: 375 - protein, 26 aa, Artificial Sequence
  source: /note="Description of Artificial Sequence: Synthetic peptide"
  MOD_RES (4)..(9): Any amino acid
  MOD_RES (11)..(18): Any amino acid
CKVXXXXXXCXXXXXXXXDVYGGGTV

SEQ ID NO: 376 - protein, 26 aa, Artificial Sequence
  source: /note="Description of Artificial Sequence: Synthetic peptide"
  MOD_RES (4)..(9): Any amino acid
  MOD_RES (11)..(18): Any amino acid
CKVXXXXXXCXXXXXXXXDVYGGGTA

SEQ ID NO: 377 - protein, 26 aa, Artificial Sequence
  source: /note="Description of Artificial Sequence: Synthetic peptide"
  MOD_RES (4)..(9): Any amino acid
  MOD_RES (11)..(18): Any amino acid
CKVXXXXXXCXXXXXXXXDVYGDGTA

SEQ ID NO: 378 - protein, 26 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(18): Any amino acid
  misc_feature (1)..(26): /note="Variant residues given in the sequence have no preference with respect to those in the annotations for variant positions"
CKVXXXXXXNNNXXXXXXDVYGGGTV

SEQ ID NO: 379 - protein, 26 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(18): Any amino acid
  misc_feature (1)..(26): /note="Variant residues given in the sequence have no preference with respect to those in the annotations for variant positions"
CKVXXXXXXNNNXXXXXXDVYGGGTA

SEQ ID NO: 380 - protein, 26 aa, Artificial Sequence
  source: /note="Description of Artificial Sequence: Synthetic peptide"
  MOD_RES (4)..(9): Any amino acid
  VARIANT (10)..(12): /replace="Ser" or "Asp" or "Gly" or "Tyr" or "Cys"
  MOD_RES (13)..(18): Any amino acid
  misc_feature (1)..(26): /note="Variant residues given in the sequence have no preference with respect to those in the annotations for variant positions"
CKVXXXXXXNNNXXXXXXDVYGDGTA

SEQ ID NO: 381 - protein, 27 aa, Artificial Sequence
  source: /note="Description of Artificial Sequence: Synthetic peptide"
  MOD_RES (4)..(13): Any amino acid
  MOD_RES (15)..(19): Any amino acid
CKVXXXXXXXXXXCXXXXXDVYGGGTV

SEQ ID NO: 382 - protein, 27 aa, Artificial Sequence
  source: /note="Description of Artificial Sequence: Synthetic peptide"
  MOD_RES (4)..(13): Any amino acid
  MOD_RES (15)..(19): Any amino acid
CKVXXXXXXXXXXCXXXXXDVYGGGTA

SEQ ID NO: 383 - protein, 27 aa, Artificial Sequence
  source: /note="Description of Artificial Sequence: Synthetic peptide"
  MOD_RES (4)..(13): Any amino acid
  MOD_RES (15)..(19): Any amino acid
CKVXXXXXXXXXXCXXXXXDVYGDGTA

SEQ ID NO: 384 - protein, 27 aa, Artificial Sequence
  source: /note="Description of Artificial Sequence: Synthetic peptide"
  MOD_RES (4)..(11): Any amino acid
  VARIANT (12)..(14): /replace="Ser" or "Asp" or "Gly" or "Tyr" or "Cys"
  MOD_RES (15)..(19): Any amino acid
  misc_feature (1)..(27): /note="Variant residues given in the sequence have no preference with respect to those in the annotations for variant positions"
CKVXXXXXXXXNNNXXXXXDVYGGGTV

SEQ ID NO: 385 - protein, 27 aa, Artificial Sequence
  source: /note="Description of Artificial Sequence: Synthetic peptide"
  MOD_RES (4)..(11): Any amino acid
  VARIANT (12)..(14): /replace="Ser" or "Asp" or "Gly" or "Tyr" or "Cys"
  MOD_RES (15)..(19): Any amino acid
  misc_feature (1)..(27): /note="Variant residues given in the sequence have no preference with respect to those in the annotations for variant positions"
CKVXXXXXXXXNNNXXXXXDVYGGGTA

SEQ ID NO: 386 - protein, 27 aa, Artificial Sequence
  source: /note="Description of Artificial Sequence: Synthetic peptide"
  MOD_RES (4)..(11): Any amino acid
  VARIANT (12)..(14): /replace="Ser" or "Asp" or "Gly" or "Tyr" or "Cys"
  MOD_RES (15)..(19): Any amino acid
  misc_feature (1)..(27): /note="Variant residues given in the sequence have no preference with respect to those in the annotations for variant positions"
CKVXXXXXXXXNNNXXXXXDVYGDGTA

SEQ ID NO: 387 - protein, 107 aa, Artificial Sequence
  source: /note="Description of Artificial Sequence: Synthetic polypeptide"
ARVDQTPRSVTKETGESLTINCVLRDSICALSSTHWYRKKSGSTNEESISKGGRYVETVNSGSKSFSLRINDLTVEDSGTYRCNVHLLNCYSKSDVYGGGTVVTVNA

SEQ ID NO: 388 - protein, 107 aa, Artificial Sequence
  source: /note="Description of Artificial Sequence: Synthetic polypeptide"
ARVDQTPQTVTKETGESLTINCVLRDSICALSSTYWYRKKSGSTNEARISKGGRYVETVNSGSKSFSLRINDLTVEDSGTYRCNVQYFYCDLDSDVYGGGTVVTVNA

SEQ ID NO: 389 - protein, 107 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRCNVBFTSCGVFRDVYGGGTAVTVNA

SEQ ID NO: 390 - protein, 107 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLTVEDSGTYRCNVFEFNNYERVDVYGDGTAVTVNA

SEQ ID NO: 391 - protein, 107 aa, Artificial Sequence
  source: /note="Description of Artificial Sequence: Synthetic polypeptide"
ARVDQTPQTITKETGESLTINCVLRDSNCALSSTYWYRTKSGSRNEESISKGGRYVETVNSGSKSFSLRINDLTVEDSGTYRCNVTWSLCLPMGDVYGGGTAVTVNA

SEQ ID NO: 392 - protein, 107 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVKDSGTYRCNVTISGNNMNVDVYGGGTAVTVNA

SEQ ID NO: 393 - protein, 107 aa, Artificial Sequence
  source: /note="Description of Artificial Sequence: Synthetic polypeptide"
ARVDQTPQTITKETGESLTINCVLRDSNCALSSTYWYRTKSGSRNEESISKGGRYVETVNSGSKSFSLRINDLTVEDSGTYRCNVVAQNCDMDRDVYGDGTAVTVNA

SEQ ID NO: 394 - protein, 107 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVKDSGTYRCNVLSLSCYFMDDVYGGGTAVTVNA

SEQ ID NO: 395 - protein, 107 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCNVGDTSDYAQEDVYGGGTAVTVNA

SEQ ID NO: 396 - protein, 108 aa, Artificial Sequence
  source: /note="Description of Artificial Sequence: Synthetic polypeptide"
ARVDQTPRSVTKETGESLTINCVLRDSICALSSTHWYRKKSGSTNEESISKGGRYVETVNSGSKSFSLRINDLTVEDSGTYRCNVQRPGSCMGEGDVYGGGTAVTVNA

SEQ ID NO: 397 - protein, 108 aa, Artificial Sequence
  source: /note="Description of Artificial Sequence: Synthetic polypeptide"
ARVDQTPRSVTKETGESLTINCVLRDSICALSTTYWYRKKSGSTNEENISKGGRYVETVNSGSKSFSLRINDLTVEDSGTYRCNVERKPGCGHSDDVYGDGTAVTVNA

SEQ ID NO: 398 - protein, 108 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLKINDLTVEDSGTYRCNVRCCGGCCBYVDVYGDGTAVTVNA

SEQ ID NO: 399 - protein, 108 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVKDSGTYRCNVHLHBFCMGCRDVYGDGTAVTVNA

SEQ ID NO: 400 - protein, 108 aa, Artificial Sequence
  source: /note="Description of Artificial Sequence: Synthetic polypeptide"
ARVDQTPQTITKETGESLTINCVLRDSNCALSNLYWYRKKSGSTNEESISKGGRYVETVNSGSKSFSLRINDLTVEDSGTYRCNVPTHKKCVBVNDVYGGGTAVTVNA

SEQ ID NO: 401 - protein, 108 aa, Artificial Sequence
  source: /note="Description of Artificial Sequence: Synthetic polypeptide"
ARVDQTPQTITKETGESLTINCVLRDSICALSSTHWYRKKSGSTNEESISKGGRYVETVNSGSKSFSLRINDLVVEDSGTYRCNVTSLGGCVKVWDVYGGGTAVTVNA

SEQ ID NO: 402 - protein, 108 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLKINDLTVEDSGTYRCNVSBDLQCLVTLDVYGGGTAVTVNA

SEQ ID NO: 403 - protein, 108 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLTVEDSGTYRCNVIGKGCYVBSBDVYGGGTVVTVNA

SEQ ID NO: 404 - protein, 108 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLTVEDSGTYRCNVBWGPECWASADVYGGGTAVTVNA

SEQ ID NO: 405 - protein, 108 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLRINDLTVEDSGTYRCNVNBFWGCPFRCDVYGGGTAVTVNA

SEQ ID NO: 406 - protein, 108 aa, Artificial Sequence
  source: /note="Description of Artificial Sequence: Synthetic polypeptide"
ARVDQTPQTVTKETGESLTINCVLRDSNCALSSTYWYRKKSDSTNEESISKGGRYVETVNSGSKSFSLRINDLTVEDSGTYRCNVVGFVYCWRQFDVYGGGTAVTVNA

SEQ ID NO: 407 - protein, 109 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLTVKDSGTYRCNVBVHKGDCDLICDVYGGGTAVTVNA

SEQ ID NO: 408 - protein, 109 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRCNVLWGFSDYCVVRDVYGGGTAVTVNA

SEQ ID NO: 409 - protein, 109 aa, Artificial Sequence
  source: /note="Description of Artificial Sequence: Synthetic polypeptide"
ARVDQTPQTITKETGESLTINCVLRDSICALSSTHWYRKKSGSTNEESISKGGRYVETVNSGSKSFSLRINDLTVEDSGTYRCNVHVWTHYACHMSDVYGDGTAVTVNA

SEQ ID NO: 410 - protein, 109 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRCNVGTFECWNCLGADVYGGGTVVTVNA

SEQ ID NO: 411 - protein, 109 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRCNVWFRTIDDDRLRDVYGGGTVVTVNA

SEQ ID NO: 412 - protein, 109 aa, Artificial Sequence
  source: /note="Description of Artificial Sequence: Synthetic polypeptide"
ARVDQTPQTITKETGESLTINCVLRDSNCALSSTLWYRTKSGSRNEESISKGGRYVETVNSGSKSFSLRINDLTVEDSGTYRCNVAVWDTCLCGACDVYGGGTVVTVNA

SEQ ID NO: 413 - protein, 109 aa, Artificial Sequence
  source: /note="Description of Artificial Sequence: Synthetic polypeptide"
ARVDQTPQTITKETGESLTINCVLRDNNCALSTTYWYRKKSGSTNEARISKGGRYVETVNSGSKSFSLKINDLTVEDSGTYRCNVLIGSSTECPCGDVYGGGTVVTVNA

SEQ ID NO: 414 - protein, 109 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLTVEDSGTYRCNVASFIVDDYYGDDVYGGGTAVTVNA

SEQ ID NO: 415 - protein, 110 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCNVLRCSGBBCYTCVDVYGGGTVVTVNA

SEQ ID NO: 416 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVHRYGMAYDNCAKDVYGGGTVVTVNA

SEQ ID NO: 417 - protein, 110 aa, Artificial Sequence
  source: /note="Description of Artificial Sequence: Synthetic polypeptide"
ARVDQTPQTITKETGESLTINCVLRDSNCELSSTYWYRKKSGSTNEARISKGGRYVETVNSGSKSFSLRINDLTVEDSGTYRCNVQYDLVVYGCNNTDVYGDGTAVTVNA

SEQ ID NO: 418 - protein, 110 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVMDRSWRLCYSALDVYGGGTAVTVNA

SEQ ID NO: 419 - protein, 110 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLKINDLTVEDSGTYRCNVPYHGEFLCPVKPDVYGGGTAVTVNA

SEQ ID NO: 420 - protein, 110 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCNVVSGNVSKCHSGCDVYGGGTVVTVNA

SEQ ID NO: 421 - protein, 110 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVEDSGTYRCNVHLBFLVMCCRBRDVYGGGTVVTVNA

SEQ ID NO: 422 - protein, 110 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCNVLGIQLISGYNVSDVYGGGTVVTVNA

SEQ ID NO: 423 - protein, 110 aa, Artificial Sequence
  source: /note="Description of Artificial Sequence: Synthetic polypeptide"
ARVDQTPQTITKETGESLTINCVLRDSICALSSTHWYRKKSGSTNEESISKGGRYVETVNSGSKSFSLKINDLTVEDSGTYRCNVFRDEDLTCGKDGDVYGGGTAVTVNA

SEQ ID NO: 424 - protein, 111 aa, Artificial Sequence
  source: /note="Description of Artificial Sequence: Synthetic polypeptide"
ARVDQTPQTITKETGESLTINCVLRDSNCALSSTLWYRTKSGSRNEESISKGGRYVETVNSGSKSFSLRINDLTVEDSGTYRCNVSISGFYGSDAVFCDVYGGGTAVTVNA

SEQ ID NO: 425 - protein, 111 aa, Artificial Sequence
  source: /note="Description of Artificial Sequence: Synthetic polypeptide"
ARVDQTPQTITKETGESLTINCVLRDSNCALSSTLWYRKKSGSTNEESISKGGRYVETVNSGSKSFSLRINDLTVEDSGTYRCNVDTLKLHFCLLEKIDVYGGGTAVTVNA

SEQ ID NO: 426 - protein, 111 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCNVRIVTLTFCDRMAGDVYGGGTAVTVNA

SEQ ID NO: 427 - protein, 111 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCNVADQIVINCPSDREDVYGDGTAVTVNA

SEQ ID NO: 428 - protein, 111 aa, Artificial Sequence
  source: /note="Description of Artificial Sequence: Synthetic polypeptide"
ARVDQTPQTITKETGESLTINCVLRDSNCALSSTLWYRTKSGSRNEESISKGGRYVETVNSGSKSFSLKINDLTVEDSGTYRCNVDGLPCSYSCCPTCDVYGDGTAVTVNA

SEQ ID NO: 429 - protein, 111 aa, Artificial Sequence
  source: /note="Description of Artificial Sequence: Synthetic polypeptide"
ARVDQTPRSVTKETGESLTINCVLRDSNCALPSTYWYRKKSGSTNEESISLGGRYVETVNSGSKSFSLRINDLTVEDSGTYRCNVATSTCLWCCVEDGDVYGDGTAVTVNA

SEQ ID NO: 430 - protein, 111 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLRINDLVVEDSGTYRCNVMCAPBLDNSABLRDVYGGGTAVTVNA

SEQ ID NO: 431 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVSLGKVVDCRLWLVDVYGGGTAVTVNA

SEQ ID NO: 432 - protein, 111 aa, Artificial Sequence
  source: /note="Description of Artificial Sequence: Synthetic polypeptide"
ARVDQTPRSVTKETGESLTINCVLRDSICALSSTHWYRKKSGSTNEESISKGGRYVETVNSGSKSFSLRINDLTVKDSGTYRCNVVNRFGRPCASGRTDVYGDGTAVTVNA

SEQ ID NO: 433 - protein, 112 aa, Artificial Sequence
  source: /note="Description of Artificial Sequence: Synthetic polypeptide"
ARVDQTPQTITKETGESLTINCVLRDSNCDLSRTYWYRKKSGSTNEESISKGGRYVETVNSGSKSFSLRINDLTVEDSGTYRCKVAQQYVDLCGRACRMDVYGGGTVVTVNA

SEQ ID NO: 434 - protein, 112 aa, Artificial Sequence
  source: /note="Description of Artificial Sequence: Synthetic polypeptide"
ARVDQTPQTITKETGESLTINCVLRDSNCELSSTYWYRKKSDSTNEESISKGGRYVETVNSGSKSFSLRINDLTVEDSGTYRCKVQGSWGAACRSSQAPDVYGGGTVVTVNA

SEQ ID NO: 435 - protein, 112 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLRINDLTVEDSGTYRCKVSIDYVNLSEESRNPDVYGDGTAVTVNA

SEQ ID NO: 436 - protein, 112 aa, Artificial Sequence
  source: /note="Description of Artificial Sequence: Synthetic polypeptide"
ARVDQTPQTITKETGESLTINCVLRDSNCALPSTYWYRKKSGSTNEARISKGGRYVETVNSGSKSFSLRINDLTVKDSGTYRCKVTGVSRWSCBRERYMDVYGDGTAVTVNA

SEQ ID NO: 437 - protein, 112 aa, Artificial Sequence
  source: /note="Description of Artificial Sequence: Synthetic polypeptide"
ARVDQTPQTITKETGESLTINFVLRDSNCALSSTLWYRTKSGSRNEESISKGGRYVETVNSGSKSFSLKINDLTVEDSGTYRCKVMLVQSBECRGVWRGDVYGGGTAVTVNA

SEQ ID NO: 438 - protein, 112 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCKVSRRSKIGCVBRSGSDVYGGGTVVTVNA

SEQ ID NO: 439 - protein, 112 aa, Artificial Sequence
  source: /note="Description of Artificial Sequence: Synthetic polypeptide"
ARVDQTPQTITKETGESLTINCVLRDNNCALSTTYWYRKKSGSTNEENISKGGRYVETVNSGSKSFSLRINDLTVEDSGTYRCKVDVIRPSYCRYCFCGDVYGDGTAVTVNA

SEQ ID NO: 440 - protein, 112 aa, Artificial Sequence
  source: /note="Description of Artificial Sequence: Synthetic polypeptide"
ARVDQTPQTITKETGESLTINCVLRDSNCALSSTLWYRTKSGSRNEESISKGGRYVETVNSGSKSFSLRINDLTVEDSGTYRCKVLMBIBRLCSGSSEDDVYGGGTAVTVNA

SEQ ID NO: 441 - protein, 112 aa, Artificial Sequence
  source: /note="Description of Artificial Sequence: Synthetic polypeptide"
ARVDQTPQTITKETGESLTINCVLRDSNCALSTTYWYRKKSGSTNEESISLGGRYVETVNSGSKSFSLRINDLTVEDSGTYRCKVLEVSWGNGPIGNLGDVYGGGTVVTVNA

SEQ ID NO: 442 - protein, 113 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLRINDLTVEDSGTYRCKVAPGGCCNDCSKLBSIDVYGGGTVVTVNA

SEQ ID NO: 443 - protein, 113 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVKDSGTYRCKVGPLLLVDGYEGGRRLDVYGGGTVVTVNA

SEQ ID NO: 444 - protein, 113 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLRINDLTVEDSGTYRCKVPTGSPGGCYSEGGSGDVYGGGTVVTVNA

SEQ ID NO: 445 - protein, 113 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLRINDLTVEDSGTYRCKVBBYIPKCTDBVYNDWDVBGDGTAVTVNA

SEQ ID NO: 446 - protein, 113 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCKVRSVEPVCKWBWRGGDDVYGDGTAVTVNA

SEQ ID NO: 447 - protein, 113 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLRINDLTVEDSGTYRCKVWCVYVGCSCGLQVIGDVYGGGTAVTVNA

SEQ ID NO: 448 - protein, 113 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLRINDLTVEDSGTYRCKVFRALVVNSNRRBSPHDVYGGGTAVTVNA

SEQ ID NO: 449 - protein, 113 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCKVCSFLLGNCDGDAKLFDVYGGGTVVTVNA

SEQ ID NO: 450 - protein, 114 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCKVMQVRGQPDTVCPTGVSDVYGDGTVVTVNA

SEQ ID NO: 451 - protein, 114 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCKVQRGVCPDDDGDGVLGGDVYGGGTAVTVNA

SEQ ID NO: 452 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLRINDLTVEDSGTYRCKVTMHBWRWICCGQGKWADVYGGGTAVTVNA

SEQ ID NO: 453 - protein, 114 aa, Artificial Sequence
  source: /note="Description of Artificial Sequence: Synthetic polypeptide"
ARVDQTPQTITKETGESLTINCVLRDSNCALHSTYWYRKKSGSTNEESISKGGRYVETVNSGSKSFSLRINDLTVEDSGTYRCKVDCRVPBMLVRCWGPWVDVYGDGTAVTVNA

SEQ ID NO: 454 - protein, 114 aa, Artificial Sequence
  source: /note="Description of Artificial Sequence: Synthetic polypeptide"
ARVDQTPQTVTKETGESLTINCVLRDNNCALSTTYWYRKKSGSTNEENISKGGRYVETVNSGSKSFSLKINDLTVEDSGTYRCKVCMINRSSFNCDGVMLLDVYGGGTVVTVNA

SEQ ID NO: 455 - protein, 114 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLRINDLTVEDSGTYRCKVSMIMLGNRGCYGNSSADVYGGGTVVTVNA

SEQ ID NO: 456 - protein, 114 aa, Artificial Sequence
  source: /note="Description of Artificial Sequence: Synthetic polypeptide"
ARVDQTPQTITKETGESLTINCVLRDSNCALSNLYWYRKKSGSTNEESISLGGRYVETVNSGSKSFSLRINDLTVEDSGTYRCKVVNDGCGGFLWCVVMVKDVYGGGTAVTVNA

SEQ ID NO: 457 - protein, 114 aa, Artificial Sequence
  source: /note="Description of Artificial Sequence: Synthetic polypeptide"
ARVDQTPQTITKETGESLTINCVLRDSNCELSSTYWYRKKSGSTNEENISKGGRYVETVNSGSKSFSLKINDLTVEDSGTYRCKVWFRIACABPGCYRVPSDVYGDGTAVTVNA

SEQ ID NO: 458 - protein, 114 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLVVEDSGTYRCKVTTELAPVLGGCRFTRADVYGGGTVVTVNA

SEQ ID NO: 459 - protein, 114 aa, Artificial Sequence
  source: /note="Description of Artificial Sequence: Synthetic polypeptide"
ARVDQTPQTITKETGESLTINCVLRDNNCALSTTYWYRKKSGSTNEESISKGGRYVETVNSGSKSFSLRINDLTVEDSGTYRCKVCAGMVFTFLRCKAFLPDVYGGGTVVTVNA

SEQ ID NO: 460 - protein, 108 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLKINDLTVEDSGTYRCNVSACVKYYGCEBDVYGDGTPBLBM

SEQ ID NO: 461 - protein, 106 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLKINDLTVEDSGTYRCNVFSGYCYSRTDVYGGGTAVTVM

SEQ ID NO: 462 - protein, 108 aa, Artificial Sequence
  source: /note="Description of Artificial Sequence: Synthetic polypeptide"
ARVDQTPQTITKETGESLTINCVLRDSNCDLSNLYWYRKKSGSTNEESISLGGRYVETVNSGSKSFSLRINDLTVEDSGTYRCNVALRSWKFAIFWMYTEMALPBLBM

SEQ ID NO: 463 - protein, 112 aa, Artificial Sequence
  source: /note="Description of Artificial Sequence: Synthetic polypeptide"
ARVDQTPQTITKETGESLTINCVLRDSNCALPSTYWYRKKSGSTNEESISKGGRYVETVNSGSKSFSLRINDLTVEDSGTYRCNVVRYFLLLPFYBCIRRWHCRDCECGLRG

SEQ ID NO: 464 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEARISKGGRYVETVNSGSKSFSLRINDLTVEDSGTYRCNVCLLRQHYCYBCIRRWHCRDCECGLRG

SEQ ID NO: 465 - protein, 109 aa, Artificial Sequence
  source: /note="Description of Artificial Sequence: Synthetic polypeptide"
ARVDQTPQTITKETGESLTINCVLRDSNCALSSTYWYRKKSGSTNEESISKGGRYVETVNSGSKSFSLRINDLTVEDSGTYRCNVCGBLDVCAWLLWMYTEVALPBLBM

SEQ ID NO: 466 - protein, 103 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCNVVLVGBGMYTEVALSBLBM

SEQ ID NO: 467 - protein, 110 aa, Artificial Sequence
  source: /note="Description of Artificial Sequence: Synthetic polypeptide"
ARVDQTPQTITKETGESLTINCVLRDSICALSSTHWYRKKSGSTNEESISKGGRYVETVNSGSKSFSLRINDLTVEDSGTYRCNVIYFPCBTTMVVGVMYTEVALSBLBM

SEQ ID NO: 468 - protein, 112 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLKINDLTVEDSGTYRCKVSRGGVYBLLCBCIRRWHCRDCECGLRG

SEQ ID NO: 469 - protein, 111 aa, Artificial Sequence
  source: /note="Description of Artificial Sequence: Synthetic polypeptide"
ARVDQTPQTITKETGESLTINCVLRDSNCALSSTYWYRKKSGSTNEENISKGGRYVETVNSGSKSFSLRINDLTVEDSGTYRCKVPSLNCCSNRHTIRVMYTEVALSBLBM

SEQ ID NO: 470 - protein, 111 aa, Artificial Sequence
  source: /note="Description of Artificial Sequence: Synthetic polypeptide"
ARVDQTPQTITKETGESLTINCVLRDSNCALSSTYWYRKKSDSTNEESISKGGRYVETVNSGSKSFSLKINDLTVEDSGTYRCKVVPLCGGBGAMFRCLMYTEVALSBLBM

SEQ ID NO: 471 - protein, 110 aa, Artificial Sequence
  source: /note="Description of Artificial Sequence: Synthetic polypeptide"
ARVDQTPRSVTKETGESLTINCVLRDSNCELSSTYWYRKKSGSTNEESISKGGRYVETVNSGSKSFSLKINDLTVEDSGTYRCKVLCLVGLIFIRVLGMYTEVALPBLBM

SEQ ID NO: 472 - protein, 111 aa, Artificial Sequence
  source: /note="Description of Artificial Sequence: Synthetic polypeptide"
ARVDQTPQTVTKETGESLTINCVLRDSNCALSSTLWYRTKSGSRNEESISKGGRYVETVNSGSKSFSLRINDLTVEDSGTYRCKVBCELLLBFGGCIRRWHCRDCECGLRG

SEQ ID NO: 473 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCRGIYSRGYSWCDWRYQSHADVLLIGVSQNAACGDGTAVTVNA

SEQ ID NO: 474 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAATRAGPRESCDYKGGSCAPPPMAYAACGDGTAVTVNA

SEQ ID NO: 475 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVMAGVDRSKYSCDYERPRALCSFHIAACGDGTAVTVNA

SEQ ID NO: 476 - protein, 26 aa, Artificial Sequence
  source: /note="Description of Artificial Sequence: Synthetic peptide"
  MOD_RES (1)..(9): Any amino acid
  MOD_RES (12)..(16): Any amino acid
  MOD_RES (18)..(24): Any amino acid
XXXXXXXXXCDXXXXXCXXXXXXXAA

SEQ ID NO: 477 - protein, 103 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGALABSGAACGDGTAVTVNA

SEQ ID NO: 478 - protein, 106 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCSTDTDGQAACGDGTAVTVNA

SEQ ID NO: 479 - protein, 108 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAMSMRLIRGLCAACGDGTAVTVNA

SEQ ID NO: 480 - protein, 111 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCBGACBSCYWFCAAACGDGTAVTVNA

SEQ ID NO: 481 - protein, 112 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVSGLQGMGWPCLFAGAACGDGTAVTVNA

SEQ ID NO: 482 - protein, 114 aa, Artificial Sequence
  source: /note="Description of Artificial Sequence: Synthetic polypeptide"
  MOD_RES (96)..(97): Any amino acid
ARVDQTPRSVTKETGESLTINCVLRDASYELGSTCWYRKKSGSTNEESISKGGRYVETVNSGSKSFSLRINDLTVEDGGTYRCGAERLRGVDRSCXXVLEGAACGDGTAVTVNA

SEQ ID NO: 483 - protein, 115 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAVLWRLSRRSCDRAVGRRAACGDGTAVTVNA

SEQ ID NO: 484 - protein, 119 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVVGIGFCCDYYSLRCRYELCSWAACGDGTAVTVNA

SEQ ID NO: 485 - protein, 120 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVVRRFKMSLLNCDWAGDKLWWHLAACGDGTAVTVNA

SEQ ID NO: 486 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGARRPLSFGATCDAFMTSCLYTWRFEAACGDGTAVTVNA

SEQ ID NO: 487 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAWVLCRVRFKCDVMRBDCWFLRSBMAACGDGTAVTVNA

SEQ ID NO: 488 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVSPPNSSGQVGCDAGLCRVWCTMSLAACGDGTAVTVNA

SEQ ID NO: 489 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVNVWEVSSRTDCDLLVTAEECRGMWAACGDGTAVTVNA

SEQ ID NO: 490 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGVSVRWBRVEVACDYGSCBSICLVSGAACGDGTAVTVNA

SEQ ID NO: 491 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAELEEKRNRRCDBLGVSCPRWBBAAAACGDGTAVTVNA

SEQ ID NO: 492 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAINLSMCSCCCDAGGSVCVLVVKVVAACGDGTAVTVNA

SEQ ID NO: 493 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVGTHKAHKLGMCDGSSLTVWCBPARAACGDGTAVTVNA

SEQ ID NO: 494 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGARWYIYASARCDLPWSQCRGKCCSAAACGDGTAVTVNA

SEQ ID NO: 495 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGARWCSSWRVPCDNGSHACGGMEGBVAACGDGTAVTVNA

SEQ ID NO: 496 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGASRWHRVAIRCDVESVVCNWBGNEEAACGDGTAVTVNA

SEQ ID NO: 497 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGACLGVYTMKMCDLLRPVCFRWRKKAAACGDGTAVTVNA

SEQ ID NO: 498 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCBDWLWPMTISCDIDBAKDCEMTQAACGDGTAVTVNA

SEQ ID NO: 499 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVVMKACNLNSFCDCFREQGWCWLWVAACGDGTAVTVNA

SEQ ID NO: 500 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVVNSCGEPAAQCDFRHAYGMCLWVLAACGDGTAVTVNA

SEQ ID NO: 501 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVEPYGVPTYWGCDIRRASVKCFSGSAACGDGTAVTVNA

SEQ ID NO: 502 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAATYSLRRGPCDDNLMCCSWCEINLAACGDGTAVTVNA

SEQ ID NO: 503 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVNSLBYGAVEBCDWSDLVALCVDMGAACGDGTAVTVNA

SEQ ID NO: 504 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAGNTMFMBLBCDNRWVNCRVVPWVEAACGDGTAVTVNA

SEQ ID NO: 505 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGANFRBGATQGCDENWASCWLVWRRSTACGDGTAVTVNA

SEQ ID NO: 506 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGALDYGAVELCCDQPVLACVGVREWAAACGDGTAVTVNA

SEQ ID NO: 507 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAGCLHRSGEGCDAYCIKCEAKBWDGAACGDGTAVTVNA

SEQ ID NO: 508 - protein, 122 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVRGQAIQVRKLCDMQAPPDRCTPWWAACGDGTAVTVNA

SEQ ID NO: 509 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGALFRWWVTMVCDHRKVACGLVHCSLAACGDGTAVTVNA

SEQ ID NO: 510 - protein, 122 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGASQWCLGRTACDGFRSLCLTWPICWAACGDGTAVTVNA

SEQ ID NO: 511 - protein, 123 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGVRIGGVAEMVSCDRRMETCKLPLRLEAACGDGTAVTVNA

SEQ ID NO: 512 - protein, 124 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCFRRMIYLHVSCDWGHQRRAARLKPAAACGDGTAVTVNA

SEQ ID NO: 513 - protein, 125 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRAGVCLFLVSNGLBFCDPLCFABABLSIGFEAACGDGTAVTVNA

SEQ ID NO: 514 - protein, 126 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCMMIPNGMTNNCDKLTLQSDDTFVCSVCAACGDGTAVTVNA

SEQ ID NO: 515 - protein, 128 aa, Artificial Sequence
  source: /note="Description of Artificial Sequence: Synthetic polypeptide"
  MOD_RES (109)..(109): Any amino acid
  MOD_RES (114)..(114): Any amino acid
ARVDQTPRSVTKETGESLTINCVLRDASYALGSTCWYRKKSGSTNEESISKGGRYVETVNSGSKSFSLRINDLTVEDGGTYRCGVCSSDSGVDNRVCDDFRPWLRKVAXACDKXQAACGDGTAVTVNA

SEQ ID NO: 516 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCKBLBGYWSDHCDTIVINIILTSVTLIFBTAACGDGTAVTVNA

SEQ ID NO: 517 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCNAVLHSETIKCDGRVITKAWBCFQGTMGPAACGDGTAVTVNA

SEQ ID NO: 518 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCLMKSVRFGTPCDFSGTTLNSNVWVHTNINAACGDGTAVTVNA

SEQ ID NO: 519 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCLSTSSFFGBVCDNPFABFGHLTLCDSAPRAACGDGTAVTVNA

SEQ ID NO: 520 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCCPFSPVRQVDCDKVLRBSSIVQYGRMSGNAACGDGTAVTVNA

SEQ ID NO: 521 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCTYSQPLFLFRCDVLYDPGLTLFVRISWMLAACGDGTAVTVNA

SEQ ID NO: 522 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCRTSFFSLHILCDYLLSRTHNIAFHSSRREAACGDGTAVTVNA

SEQ ID NO: 523 - protein, 128 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCSINPTVFTCLCDLPFTHRSGCHARLNTLSAACGDGTAVTVNA

SEQ ID NO: 524 - protein, 141 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAFITCGCLNHRVVGGCMRRWHCRDCECGLRGPPSPSPWRRLQGRRRQVGIQRYQSBN

SEQ ID NO: 525 - protein, 138 aa, Artificial Sequence
  source: /note="Description of Artificial Sequence: Synthetic polypeptide"
  MOD_RES (102)..(102): Any amino acid
  MOD_RES (120)..(120): Any amino acid
  MOD_RES (137)..(138): Any amino acid
ARVDQTPRSVTKETGESLTINCVLRDASYALGSTCWYRKKSGSTNEESISKGGRYVETVNSGSKSFSLRINDLTVEDGGTYRCGVPCLFLDGVRLYGCCMRXWHCRDCECGLRGPPSPSXWRRLQGRRRQVGIQRYXX

SEQ ID NO: 526 - protein, 141 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAPVYAGMLSBCVADVCCMRRWHCRDCECGLRGPPSPSPWRRLQGRRRQVGIQRYQSB

SEQ ID NO: 527 - protein, 141 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCYILSDYSFLLBYWSCYGCYFVAVSSYAFCCMRRWHCRDCECGLRGPPSPSPWRRL

SEQ ID NO: 528 - protein, 141 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCSGDCLGLPHRCDSAVFPLLSFILLHAEMALPBLBMRPQGPTITITMAQTTRTTTT

SEQ ID NO: 529 - protein, 141 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVRCSQPBVPWECDWESSRAVCLVVLRLMFVTGSRICGSARLSWLHAEMALPBLBMRP

SEQ ID NO: 530 - protein, 141 aa, Artificial Sequence
  source: /note="Description of Artificial Sequence: Synthetic polypeptide"
ARVDQTPRSVTKETGESLTINCVLRDASYALGSTCWYRKKSGSTNEESISKGGBYVETVNSGSKSFSLRINDLTVEDGGTYRCGVPLRSSVRVHVCDSMVLKIGAGGRWLHAEMALPBLBMRPQGPTITITMAQTTRTTTT

SEQ ID NO: 531 - protein, 141 aa, Artificial Sequence
  source: /note="Description of Artificial Sequence: Synthetic polypeptide"
  MOD_RES (134)..(134): Any amino acid
ARVDQTPRSVTKETGESLTINCVLRDASYELGSTCWYRKKSGSTNEESISKGGRYVETVNSGSKSFSLRINDLTVEDGGTYRCGASGLSRYLQGCDSRRVDCRKVGLGWGCMRRWHCRDCECGLRGPPSPSPWXILQGRRR

SEQ ID NO: 532 - protein, 141 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAYBLFQAWILCDDYITGCRLVTKVLAACEMALPBLBMRPQGPTITITMAQTTRTTTT

SEQ ID NO: 533 - protein, 141 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGDVBRWBDGGVLRAVYCCMRRWHCRDCECGLRGPPSPSPWRRLQGRRRQVGIQRYQSB

SEQ ID NO: 534 - protein, 142 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVRGIMFVLEYVCCMRRWHCRDCECGLRGPPSPSPWRRLQGRRRQVGIQRYQSBNCBKL

SEQ ID NO: 535 - protein, 140 aa, Artificial Sequence
  source: /note="Description of Artificial Sequence: Synthetic polypeptide"
  MOD_RES (88)..(92): Any amino acid
  MOD_RES (95)..(96): Any amino acid
  MOD_RES (98)..(98): Any amino acid
ARVDQTPRSVTKETGESLTINCVLRDASYALGSTCWYRKKSGSTNEESISKGGRYVETVNSGSKSFSLRINDLTVEDGGTYRCGVGSXXXXXGCXXRXWHCRDCECGLRGPPSPSPWRRLQGRRRQVGIQRYQSBNCBKL

SEQ ID NO: 536 - protein, 141 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGANVAQGALWCCDRGGHNCWVRTGGAGCMRRWHCRDCECGLRGPPSPSPWRRLQGRRR

SEQ ID NO: 537 - protein, 141 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTIVAVSAVVCVGIGIMLVFFCVLFBVFVGLSLCSDCCMRRWHCRDCECGLRGPPSPSPWRRL

SEQ ID NO: 538 - protein, 139 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVQMSVIFFGVCSALGRMLHAEMALPBLBMRPQGPTITITMAQTTRTTTTSRDPKI

SEQ ID NO: 539 - protein, 142 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYLAVSAIBGCCGVCRRVIMLLRWRLVCLVLFCVIVLHAEMALPBLBMRPQGPTITITMAQTT

SEQ ID NO: 540 - protein, 139 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGAGBRAVFGGGEDVCCMRRWHCRDCECGLRGPPSPSPWRRLQGRRRQVGIQRYQSB

SEQ ID NO: 541 - protein, 139 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCEPVLVSCMCVVILLLMRVLLFFRGFGSRGLHAEMALPBLBMRPQGPTITITMA

SEQ ID NO: 542 - protein, 138 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTIVAVSABRLFLIWLMVVGIRLHAEMALPBLBMRPQGPTITITMAQTTRTTTTSRDPKI

SEQ ID NO: 543 - protein, 142 aa, Artificial Sequence
  source: /note="Description of Artificial Sequence: Synthetic polypeptide"
ARVDQTPRSVTKETGESLTINCVLRDASYELGSTCWYRKKSGSTNEESISKGGRYVETVNSGSKSFSLRINDLTVEDGGTYRCGASLPKPQKTMCDRNPMRCGIGVWVLHAEMALPBLBMRPQGPTITITMAQTTRTTTTSR

SEQ ID NO: 544 - protein, 142 aa, Artificial Sequence
  source: /note="Description of Artificial Sequence: Synthetic polypeptide"
ARVDQTPRSVTKETGESLTINCVLRDASYALGSTCWYRKKSGSTNEESISKGGRYVETVNSGSKSFSLRINDLTVEDGGTYRCGVCVLVDYCDVLGCMRRWHCRDCECGLRGPPSPSPWRRLQGRRRQVGIQRYQSBNCBKL

SEQ ID NO: 545 - protein, 140 aa, Artificial Sequence
  source: /note="Description of Artificial Sequence: Synthetic polypeptide"
  MOD_RES (131)..(131): Any amino acid
  MOD_RES (135)..(137): Any amino acid
  MOD_RES (140)..(140): Any amino acid
ARVDQTPRSVTKETGESLTINCVLRDASYALGSTCWYRKKSGSTNEESISKGGRYVETVNSGSKSFSLRINDLTVEDGGTYRCGVFMALMMLPPPCDGQWTAWRRGLHAEMALPBLBMRPQGPTITITMAXTTRXXXTSX

SEQ ID NO: 546 - protein, 6 aa, Artificial Sequence
  source: /note="Description of Artificial Sequence: Synthetic 6xHis tag"
HHHHHH

What is claimed is:

1. A nucleic acid-containing library whose members each comprise a nucleic acid encoding a polypeptide comprising a VNAR Type 2 backbone amino acid sequence comprising a semi-synthetic Type 2 VNAR framework (FW), hypervariable (HV) and complementary determining region (CDR) regions having a domain structure, from N- to C-terminal:

FW1-CDR1-FW2-HV2-FW2'-HV4-FW3-CDR3-FW4 wherein said polypeptide comprises VNAR Type 2 backbone amino acid sequence:

ARVDQTPX$_1$X$_2$X$_3$$^{(10)}$TKETGESLTI$^{(20)}$
NCVLRDX$_4$X$_5$CX$_6$$^{(30)}$LX$_7$X$_8$X$_9$X$_{10}$WYR X$_{11}$
K$^{(40)}$SX$_{12}$SX$_{13}$NEX$_{14}$X$_{15}$IS$^{(50)}$
X$_{16}$GGRYVETVN$^{(60)}$SGSKSFSLX$_{17}$I$^{(70)}$
NDLX$_{18}$VX$_{19}$DSGT$^{(80)}$ YRCX$_{20}$V$^{(85)}$-[ . . .
CDR3 . . . ]-YGX$_{21}$GTX$_{22}$VTVNA    (SEQ ID NO. 9), wherein amino acid compositions at each position X are:
X$_1$=Q and R, with R being present in more than 4.4% of the polypeptides;
X$_2$=T and S, with S being present in more than 5.4% of the polypeptides;
X$_3$=I and V, with V being present in more than 4.4% of the polypeptides;
X$_4$=S and N
X$_5$=N and I, with I being present in more than 3.2% of the polypeptides;
X$_6$=A, D and E, with D being present in more than 3.2% of the polypeptides and E being present in more than 2.2% of the polypeptides;
X$_7$=S and P, with P being present in more than 2.1% of the polypeptides;
X$_8$=S, R, T and N, with T being present in more than 1% of the polypeptides, and N being present in more than 5.3% of the polypeptides;
X$_9$=T and L, with L being present in more than 1.1% of the polypeptides;
X$_{10}$=Y, H and L, with H being present in more than 2.1% of the polypeptides and L being present in more than 2.1% of the polypeptides;
X$_{11}$=K and T, with T being present in more than 4.4% of the polypeptides;
X$_{12}$=G and D, with D being present in more than 4.4% of the polypeptides;
X$_{13}$=T and R, with R being present in more than 5.3% of the polypeptides;
X$_{14}$=E and A, with A being present in more than 1.1% of the polypeptides;
X$_{15}$=S, N and R, with R being present in more than 3.2% of the polypeptides;
X$_{16}$=K and L, with L being present in more than 3.2% of the polypeptides;
X$_{17}$=R and K, with K being present in more than 3.2% of the polypeptides;
X$_{18}$=T and V, with V being present in more than 3.2% of the polypeptides;
X$_{19}$=E and K, with K being present in more than 1.1% of the polypeptides;
X$_{20}$=N and K;
X$_{21}$=G and D; and
X$_{22}$=V and A; and
wherein CDR3 comprises an amino acid sequence of from 7 to 25 amino acid residues,
wherein CDR3 comprises at least one cysteine residue,
wherein the last two amino acid residues of CDR3 are DV, and
wherein CDR3 is otherwise randomized compared to germline Type 2 VNAR sequences.

2. The nucleic acid library of claim 1, wherein the CDR3 of each polypeptide is from 7 to 25, from 9 to 20 or from 11 to 18 amino acid residues in length.

3. The nucleic acid library of claim 2, wherein together the last two amino acids of the FW3 region, the CDR3 region and the first six amino acids of the FW4 region, collectively CDR3*, are selected from any one of the sequences (i)  NV[X]$_4$C[X]$_4$DVYGGGTV, NV[X]$_4$C[X]$_4$DVYGGGTA,    (11-mer)
     NV[X]$_4$C[X]$_4$DVYGDGTA, NV[X]$_3$[Z]$_3$[X]$_3$DVYGGGTV,
     NV[X]$_3$[Z]$_3$[X]$_3$DVYGGGTA, NV[X]$_3$[Z]$_3$[X]$_3$DVYGDGTA,
     (SEQ ID NOS. 10-15, respectively), (ii) NV[X]$_5$C[X]$_4$DVYGGGTV, NV[X]$_5$C[X]$_4$DVYGGGTA,    (12-mer)
     NV[X]$_5$C[X]$_4$DVYGDGTA, NV[X]$_3$[Z]$_3$[X]$_4$DVYGGGTV,
     NV[X]$_3$[Z]$_3$[X]$_4$DVYGGGTA, NV[X]$_3$[Z]$_3$[X]$_4$DVYGDGTA,
     (SEQ ID NOS. 16-21, respectively), (iii) NV[X]$_7$C[X]$_3$DVYGGGTV, NV[X]$_7$C[X]$_3$DVYGGGTA,    (13-mer)
      NV[X]$_7$C[X]$_3$DVYGDGTA, NV[X]$_5$[Z]$_3$[X]$_3$DVYGGGTV,
      NV[X]$_5$[Z]$_3$[X]$_3$DVYGGGTA, NV[X]$_5$[Z]$_3$[X]$_3$DVYGDGTA,
      (SEQ ID NOS. 22-27, respectively), (iv) NV[X]$_7$C[X]$_4$DVYGGGTV, NV[X]$_7$C[X]$_4$DVYGGGTA,    (14-mer)
     NV[X]$_7$C[X]$_4$DVYGDGTA, NV[X]$_6$[Z]$_3$[X]$_3$DVYGGGTV,
     NV[X]$_6$[Z]$_3$[X]$_3$DVYGGGTA, NV[X]$_6$[Z]$_3$[X]$_3$DVYGDGTA,
     (SEQ ID NOS. 28-33, respectively), (v)  NV[X]$_7$C[X]$_5$DVYGGGTV, NV[X]$_7$C[X]$_5$DVYGGGTA,    (15-mer)
     NV[X]$_7$C[X]$_5$DVYGDGTA, NV[X]$_6$[Z]$_3$[X]$_4$DVYGGGTV,
     NV[X]$_6$[Z]$_3$[X]$_4$DVYGGGTA, NV[X]$_6$[Z]$_3$[X]$_4$DVYGDGTA,
     (SEQ ID NOS. 34-39, respectively), (vi) KV[X]$_7$C[X]$_6$DVYGGGTV, KV[X]$_7$C[X]$_6$DVYGGGTA,    (16-mer)
     KV[X]$_7$C[X]$_6$DVYGDGTA, KV[X]$_3$ZXZXZ[X]$_6$DVYGGGTV,
     KV[X]$_3$ZXZXZ[X]$_6$DVYGGGTA,
     KV[X]$_3$ZXZXZ[X]$_6$DVYGDGTA,
     (SEQ ID NOS. 40-45, respectively), (vii) KV[X]$_6$C[X]$_8$DVYGGGTV, KV[X]$_6$C[X]$_8$DVYGGGTA,    (17-mer)
      KV[X]$_6$C[X]$_8$DVYGDGTA, KV[X]$_6$[Z]$_3$[X]$_6$DVYGGGTV,
      KV[X]$_6$[Z]$_3$[X]$_6$DVYGGGTA, KV[X]$_6$[Z]$_3$[X]$_6$DVYGDGTA,
      (SEQ ID NOS. 46-51, respectively), -continued (viii) KV[X]$_{10}$C[X]$_5$DVYGGGTV, KV[X]$_{10}$C[X]$_5$DVYGGGTA, KV[X]$_{10}$C[X]$_5$DVYGDGTA, KV[X]$_8$[Z]$_3$[X]$_5$DVYGGGTV, KV[X]$_8$[Z]$_3$[X]$_5$DVYGGGTA or KV[X]$_8$[Z]$_3$[X]$_5$DVYGDGTA (SEQ ID NOS. 52-57, respectively), (18-mer)

and wherein each X is independently any amino acid and each Z is N, S, D, G, Y or C, provided that at least one Z is C.

4. The nucleic acid-containing library of claim 3 wherein FW1-CDR1-FW2-HV2-FW2'-HV4-FW3, less the last two amino acids of FW3, has an amino acid sequence of any one of molecules VNAR_1 to VNAR_10 (SEQ ID NOS. 320, 321, 319 and 322-328, respectively); and the remaining residues of FW4 have an amino acid sequence of VTVNA (SEQ ID NO. 58).

5. The nucleic acid library of claim 1, wherein said library is a phage display library.

6. A method of identifying a polypeptide that binds selectively to a target molecule of interest which comprises:
   a) exposing a target molecule of interest to polypeptides produced by expression of a library of claim 1; and
   b) separating polypeptides that selectively bind from those that do not selectively bind the target molecule.

7. The method of claim 6, wherein the target molecule of interest is expressed on the surface of a phage, bacterium or cell, or is attached to, tethered to or otherwise associated with a solid support.

8. The method of claim 6 which further comprises:
   c) identifying high affinity binders from the polypeptide binders, wherein high affinity binders have an affinity of from about 0.1 nM to 250 nM, 1 nM to 250 nM, 10 nM to 250 nM, 50 nM to 250 nM, 100 nM to 250 nM, 0.1 nM to 100 nM, 1 nM to 100 nM, 10 nM to 100 nM, 50 nM to 100 nM, 0.1 nM to 50 nM, 1 nM to 50 nM, 5 nM to 50 nM, 10 nM to 50 nM, 0.1 nM to 25 nM, 1 nM to 25 nM, 5 nM to 25 nM, or 10 nM to 25 nM.

9. The method of claim 6 for identifying one or more polypeptides that selectively bind to a target molecule of interest, wherein exposing a target molecule of interest to a composition comprises:
   a) contacting said target with a nucleic acid-containing library whose members each comprise a nucleic acid encoding a polypeptide comprising a VNAR Type 2 backbone amino acid sequence comprising a semi-synthetic Type 2 VNAR framework (FW), hypervariable (HV) and complementary determining region (CDR) regions having a domain structure, from N- to C-terminal:

FW1-CDR1-FW2-HV2-FW2'-HV4-FW3-CDR3-FW4 wherein said polypeptide comprises VNAR Type 2 backbone amino acid sequence:

ARVDQTPX$_1$X$_2$X$_3$$^{(10)}$TKETGESLTI$^{(20)}$
   NCVLRDX$_4$X$_5$CX$_6$$^{(30)}$LX$_7$X$_8$X$_9$X$_{10}$WYR X$_{11}$
   K$^{(40)SX}$$_{12}$SX$_{13}$NEX$_{14}$X$_{15}$IS$^{(50)}$
   X$_{16}$GGRYVETVN$^{(60)}$SGSKSFSLX$_{17}$I$^{(70)}$
   NDLX18VX$_{19}$DSGT$^{(80)}$ YRCX$_{20}$V$^{(85)}$-[ . . .
   CDR3 . . . ]-YGX$_{21}$GTX$_{22}$VTVNA (SEQ ID NO. 9), wherein amino acid compositions at each position X are:
   X$_1$=Q and R, with R being present in more than 4.4% of the polypeptides;
   X$_2$=T and S, with S being present in more than 5.4% of the polypeptides;
   X$_3$=I and V, with V being present in more than 4.4% of the polypeptides;
   X$_4$=S and N
   X$_5$=N and I, with I being present in more than 3.2% of the polypeptides;
   X$_6$=A, D and E, with D being present in more than 3.2% of the polypeptides and E being present in more than 2.2% of the polypeptides;
   X$_7$=S and P, with P being present in more than 2.1% of the polypeptides;
   X$_8$=S, R, T and N, with T being present in more than 1% of the polypeptides, and N being present in more than 5.3% of the polypeptides;
   X$_9$=T and L, with L being present in more than 1.1% of the polypeptides;
   X$_{10}$=Y, H and L, with H being present in more than 2.1% of the polypeptides and L being present in more than 2.1% of the polypeptides;
   X$_{11}$=K and T, with T being present in more than 4.4% of the polypeptides;
   X$_{12}$=G and D, with D being present in more than 4.4% of the polypeptides;
   X$_{13}$=T and R, with R being present in more than 5.3% of the polypeptides;
   X$_{14}$=E and A, with A being present in more than 1.1% of the polypeptides;
   X$_{15}$=S, N and R, with R being present in more than 3.2% of the polypeptides;
   X$_{16}$=K and L, with L being present in more than 3.2% of the polypeptides;
   X$_{17}$=R and K, with K being present in more than 3.2% of the polypeptides;
   X$_{18}$=T and V, with V being present in more than 3.2% of the polypeptides;
   X$_{19}$=E and K, with K being present in more than 1.1% of the polypeptides;
   X$_{20}$=N and K;
   X$_{21}$=G and D; and
   X$_{22}$=V and A; and
   wherein CDR3 comprises an amino acid sequence of from 7 to 25 amino acid residues,
   wherein CDR3 comprises at least one cysteine residue,
   wherein the last two amino acid residues of CDR3 are DV,
   wherein CDR3 is otherwise randomized compared to germline Type 2 VNAR sequences,
   wherein said library is a phage display library; and
   b) separating phage that selectively bind said target molecule from those that do not selectively bind said target molecule to produce an enriched phage library;
   c) repeating steps a) and b) with said enriched phage library to produce a further enriched phage library; and
   d) repeating step c) until said further enriched phage library is enriched from at least about 10- to about 10$^6$-fold or more relative to the original phage library; and
   wherein separating polypeptides that selectively bind from those that do not selectively bind the target molecule is achieved by
   e) plating said further enriched phage library and isolating and characterizing individual clones therefrom and thereby identifying one or more polypeptides that selectively bind to a target molecule of interest.

10. The method of claim 9, wherein said target molecule or said phage display library is bound to or attached to a solid support.

11. The method of claim 9, wherein said target molecule is BAFF, TfR or myostatin.

* * * * *